US006667154B1

(12) United States Patent
Wang et al.

(10) Patent No.: US 6,667,154 B1
(45) Date of Patent: Dec. 23, 2003

(54) COMPOSITIONS AND METHODS FOR THE THERAPY AND DIAGNOSIS OF LUNG CANCER

(75) Inventors: Tongtong Wang, Medina, WA (US); Chaitanya S. Bangur, Seattle, WA (US); Michael J. Lodes, Seattle, WA (US); Gary R. Fanger, Mill Creek, WA (US); Thomas S. Vedvick, Federal Way, WA (US); Darrick Carter, Seattle, WA (US); Marc W. Retter, Carnation, WA (US); Jane Mannion, Edmonds, WA (US); Liqun Fan, Bellevue, WA (US)

(73) Assignee: Corixa Corporation, Seattle, WA (US)

( * ) Notice: Subject to any disclaimer, the term of this patent is extended or adjusted under 35 U.S.C. 154(b) by 113 days.

(21) Appl. No.: 09/671,325

(22) Filed: Sep. 26, 2000

Related U.S. Application Data

(63) Continuation-in-part of application No. 09/658,824, filed on Sep. 8, 2000, which is a continuation-in-part of application No. 09/651,563, filed on Aug. 29, 2000, which is a continuation-in-part of application No. 09/614,124, filed on Jul. 11, 2000, which is a continuation-in-part of application No. 09/589,184, filed on Jun. 5, 2000, which is a continuation-in-part of application No. 09/560,406, filed on Apr. 27, 2000, which is a continuation-in-part of application No. 09/546,259, filed on Apr. 10, 2000, which is a continuation-in-part of application No. 09/533,077, filed on Mar. 22, 2000, which is a continuation-in-part of application No. 09/519,642, filed on Mar. 6, 2000, which is a continuation-in-part of application No. 09/476,300, filed on Dec. 30, 1999, which is a continuation-in-part of application No. 09/466,867, filed on Dec. 17, 1999, which is a continuation-in-part of application No. 09/419,356, filed on Oct. 15, 1999, which is a continuation-in-part of application No. 09/346,492, filed on Jun. 30, 1999, which is a continuation-in-part of application No. PCT/US00/18061, filed on Jun. 30, 1999.

(51) Int. Cl.[7] .......................... C12Q 1/68; C07H 21/04; C12P 19/34
(52) U.S. Cl. ..................... 435/6; 435/91.1; 435/91.2; 536/23.1; 536/24.32; 536/24.33
(58) Field of Search .................... 435/6, 91.1, 91.2; 536/23.1, 24.3, 24.32, 24.33

(56) References Cited

U.S. PATENT DOCUMENTS 5,589,579 A * 12/1996 Torczynski et al. ........ 536/23.1

FOREIGN PATENT DOCUMENTS

| WO | 97/33993 | * | 9/1997 |
| WO | 98/31799 | * | 7/1998 |
| WO | WO 99/38973 | | 8/1999 |
| WO | WO 00/55375 | | 9/2000 |

OTHER PUBLICATIONS

Chen et al., "Isolation and characterization of a novel gene sxpressed in multiple cancers", Oncogene, vol. 12, pp. 741–751 (1996).*
Kagaku et al, "Determination of topology of a membrane protein—using DNA fragments successively and . . . the membrane–penetrating domains", (ID X21973).*
Gure et al., "Human Lung Cancer Antigens Recognized by autologous Antibodies: Definition of a Novel cDNA . . . Gene Locus on Chromosome 3p21.3" Cancer Research, vol 58, pp. 1034–1041 (1998).*
Wu et al., "Activation of Globin Gene Expression by cDNAs from Induced K562 Cells", The journal of Biological Chemistry, vol. 266, No. 26, pp. 17566–17572 (1991).*
EMBL Accession No. AA488696, Jul. 1, 1997.
EMBL Accession No. AW950090, Jun. 7, 2000.
EMBL Accession No. T63732.1, Mar. 5, 1995.
Hillier et al., "Generation and Analysis of 280,000 Human Expressed Sequence Tags," *Genome Research* 6:807–828, 1996.
Zangemeister–Wittke and Stahel, "Novel approaches to the treatment of small–cell lung cancer," *CMLS, Cell. Mol. Life Sci.* 55(12):1585–1598, Sep. 1999.
Hara et al., "Characterization of cell phenotype by a novel cDNA library subtraction system: expression CD8 alpha in a mast cell–derived interleukin–4–dependant cell line," *Blood* 84(1):189–199, Jul. 1, 1994.
Chen et al., "Isolation and characterization of a novel gene expressed in multiple cancers," *Oncogene* 12(4):741–751, Feb. 15, 1996.
GenBank Accession No. X21973, May 18, 1999.
Güre et al., "Human lung cancer antigens recognized by autologous antibodies: definition of a novel cDNA derived from the tumor suppressor gene locus on chromosome 3p21.3," *Cancer Research* 58(1):1034–1041, Mar. 1, 1998.
Wu and Noguchi, "Activation of globin gene expression by CDNAs from induced K562 cells," *Journal of Biological Chemistry* 266(26):17566–17572, Sep. 15, 1991.
EMBL Database Accession No. AA948244, May 5, 1998.
EMBL Database Accession No. AA620697, Oct. 16, 1997.

* cited by examiner

Primary Examiner—Kenneth R. Horlick
Assistant Examiner—Cynthia Wilder
(74) Attorney, Agent, or Firm—Seed Intellectual Property Law Group PLLC

(57) ABSTRACT

Compositions and methods for the therapy and diagnosis of cancer, such as lung cancer, are disclosed. Compositions may comprise one or more lung tumor proteins, immunogenic portions thereof, or polynucleotides that encode such portions. Alternatively, a therapeutic composition may comprise an antigen presenting cell that expresses a lung tumor protein, or a T cell that is specific for cells expressing such a protein. Such compositions may be used, for example, for the prevention and treatment of diseases such as lung cancer. Diagnostic methods based on detecting a lung tumor protein, or mRNA encoding such a protein, in a sample are also provided.

5 Claims, No Drawings

COMPOSITIONS AND METHODS FOR THE THERAPY AND DIAGNOSIS OF LUNG CANCER

REFERENCE TO RELATED APPLICATIONS

This application is continuation-in-part of U.S. patent application Ser. No. 09/658,824, filed Sep. 8, 2000; U.S. patent application Ser. No. 09/651,563, filed Aug. 29, 2000; U.S. patent application Ser. No. 09/614,124, filed Jul. 11, 2000; U.S. patent application Ser. No. 09/589,184, filed Jun. 5, 2000; U.S. patent application Ser. No. 09/560,406, filed Apr. 27, 2000; U.S. patent application Ser. No. 09/546,259, filed Apr. 10, 2000; U.S. patent application Ser. No. 09/533,077, filed Mar. 22, 2000; U.S. patent application Ser. No. 09/519,642, filed Mar. 6, 2000; U.S. patent application Ser. No. 09/476,300, filed Dec. 30, 1999; U.S. patent application Ser. No. 09/466,867, filed Dec. 17, 1999; U.S. patent application Ser. No. 09/419,356, filed Oct. 15, 1999; U.S. patent application Ser. No. 09/346,492, filed Jun. 30, 1999; each a CIP of the previous application and all pending; and PCT/US00/18061, filed Jun. 30, 1999, pending.

TECHNICAL FIELD OF THE INVENTION

The present invention relates generally to therapy and diagnosis of cancer, such as lung cancer. The invention is more specifically related to polypeptides comprising at least a portion of a lung tumor protein, and to polynucleotides encoding such polypeptides. Such polypeptides and polynucleotides may be used in compositions for prevention and treatment of lung cancer, and for the diagnosis and monitoring of such cancers.

BACKGROUND OF THE INVENTION

Cancer is a significant health problem throughout the world. Although advances have been made in detection and therapy of cancer, no vaccine or other universally successful method for prevention or treatment is currently available. Current therapies, which are generally based on a combination of chemotherapy or surgery and radiation, continue to prove inadequate in many patients.

Lung cancer is the primary cause of cancer death among both men and women in the U.S., with an estimated 172,000 new cases being reported in 1994. The five-year survival rate among all lung cancer patients, regardless of the stage of disease at diagnosis, is only 13%. This contrasts with a five-year survival rate of 46% among cases detected while the disease is still localized. However, only 16% of lung cancers are discovered before the disease has spread.

Early detection is difficult since clinical symptoms are often not seen until the disease has reached an advanced stage. Currently, diagnosis is aided by the use of chest x-rays, analysis of the type of cells contained in sputum and fiberoptic examination of the bronchial passages. Treatment regimens are determined by the type and stage of the cancer, and include surgery, radiation therapy and/or chemotherapy.

In spite of considerable research into therapies for this and other cancers, lung cancer remains difficult to diagnose and treat effectively. Accordingly, there is a need in the art for improved methods for detecting and treating such cancers. The present invention fulfills these needs and further provides other related advantages.

SUMMARY OF THE INVENTION

Briefly stated, the present invention provides compositions and methods for the diagnosis and therapy of cancer, such as lung cancer. In one aspect, the present invention provides polypeptides comprising at least a portion of a lung tumor protein, or a variant thereof. Certain portions and other variants are immunogenic, such that the ability of the variant to react with antigen-specific antisera is not substantially diminished. Within certain embodiments, the polypeptide comprises a sequence that is encoded by a polynucleotide sequence selected from the group consisting of: (a) sequences recited in SEQ ID NO: 1–323, 341–782, 784–785, 788, 790, 792, 794, 796, 800–804, 807, 808, 810–826, 878–1664, 1668, 1669, 1676, 1680–1805 and 1824; and (c) complements of a sequence of (a) or (b). In specific embodiments, the polypeptides of the present invention comprise at least a portion of a tumor protein that includes an amino acid sequence selected from the group consisting of sequences recited in SEQ ID NO: 324–340, 783, 786, 787, 789, 791, 793, 795, 797–799, 805, 806, 809, 827, 1667, 1670–1675, 1677–1679, 1806–1822, 1825 and variants thereof.

The present invention further provides polynucleotides that encode a polypeptide as described above, or a portion thereof (such as a portion encoding at least 15 amino acid residues of a lung tumor protein), expression vectors comprising such polynucleotides and host cells transformed or transfected with such expression vectors.

Within other aspects, the present invention provides pharmaceutical compositions comprising a polypeptide or polynucleotide as described above and a physiologically acceptable carrier.

Within a related aspect of the present invention, vaccines, or immunogenic compositions, for prophylactic or therapeutic use are provided. Such vaccines comprise a polypeptide or polynucleotide as described above and an immunostimulant.

The present invention further provides pharmaceutical compositions that comprise: (a) an antibody or antigen-binding fragment thereof that specifically binds to a lung tumor protein; and (b) a physiologically acceptable carrier.

Within further aspects, the present invention provides pharmaceutical compositions comprising: (a) an antigen presenting cell that expresses a polypeptide as described above and (b) a pharmaceutically acceptable carrier or excipient. Antigen presenting cells include dendritic cells, macrophages, monocytes, fibroblasts and B cells.

Within related aspects, vaccines, or immunogenic compositions, are provided that comprise: (a) an antigen presenting cell that expresses a polypeptide as described above and (b) an immunostimulant.

The present invention further provides, in other aspects, fusion proteins that comprise at least one polypeptide as described above, as well as polynucleotides encoding such fusion proteins.

Within related aspects, pharmaceutical compositions comprising a fusion protein, or a polynucleotide encoding a fusion protein, in combination with a physiologically acceptable carrier are provided.

Vaccines, or immunogenic compositions, are further provided, within other aspects, that comprise a fusion protein, or a polynucleotide encoding a fusion protein, in combination with an immunostimulant.

Within further aspects, the present invention provides methods for inhibiting the development of a cancer in a patient, comprising administering to a patient a pharmaceutical composition or immunogenic composition as recited above. The patient may be afflicted with lung cancer, in which case the methods provide treatment for the disease, or patient considered at risk for such a disease may be treated prophylactically.

The present invention further provides, within other aspects, methods for removing tumor cells from a biological sample, comprising contacting a biological sample with T cells that specifically react with a lung tumor protein, wherein the step of contacting is performed under conditions and for a time sufficient to permit the removal of cells expressing the protein from the sample.

Within related aspects, methods are provided for inhibiting the development of a cancer in a patient, comprising administering to a patient a biological sample treated as described above.

Methods are further provided, within other aspects, for stimulating and/or expanding T cells specific for a lung tumor protein, comprising contacting T cells with one or more of: (i) a polypeptide as described above; (ii) a polynucleotide encoding such a polypeptide; and/or (iii) an antigen presenting cell that expresses such a polypeptide; under conditions and for a time sufficient to permit the stimulation and/or expansion of T cells. Isolated T cell populations comprising T cells prepared as described above are also provided.

Within further aspects, the present invention provides methods for inhibiting the development of a cancer in a patient, comprising administering to a patient an effective amount of a T cell population as described above.

The present invention further provides methods for inhibiting the development of a cancer in a patient, comprising the steps of: (a) incubating $CD4^+$ and/or $CD8^+$ T cells isolated from a patient with one or more of: (i) a polypeptide comprising at least an immunogenic portion of a lung tumor protein; (ii) a polynucleotide encoding such a polypeptide; and (iii) an antigen-presenting cell that expressed such a polypeptide; and (b) administering to the patient an effective amount of the proliferated T cells, and thereby inhibiting the development of a cancer in the patient. Proliferated cells may, but need not, be cloned prior to administration to the patient.

Within further aspects, the present invention provides methods for determining the presence or absence of a cancer in a patient, comprising: (a) contacting a biological sample obtained from a patient with a binding agent that binds to a polypeptide as recited above; (b) detecting in the sample an amount of polypeptide that binds to the binding agent; and (c) comparing the amount of polypeptide with a predetermined cut-off value, and therefrom determining the presence or absence of a cancer in the patient. Within preferred embodiments, the binding agent is an antibody, more preferably a monoclonal antibody. The cancer may be lung cancer.

The present invention also provides, within other aspects, methods for monitoring the progression of a cancer in a patient. Such methods comprise the steps of: (a) contacting a biological sample obtained from a patient at a first point in time with a binding agent that binds to a polypeptide as recited above; (b) detecting in the sample an amount of polypeptide that binds to the binding agent; (c) repeating steps (a) and (b) using a biological sample obtained from the patient at a subsequent point in time; and (d) comparing the amount of polypeptide detected in step (c) with the amount detected in step (b) and therefrom monitoring the progression of the cancer in the patient.

The present invention further provides, within other aspects, methods for determining the presence or absence of a cancer in a patient, comprising the steps of: (a) contacting a biological sample obtained from a patient, with an oligonucleotide that hybridizes to a polynucleotide that encodes a lung tumor protein; (b) detecting in the sample a level of a polynucleotide, preferably mRNA, that hybridizes to the oligonucleotide; and (c) comparing the level of polynucleotide that hybridizes to the oligonucleotide with a predetermined cut-off value, and therefrom determining the presence or absence of a cancer in the patient. Within certain embodiments, the amount of mRNA is detected via polymerase chain reaction using, for example, at least one oligonucleotide primer that hybridizes to a polynucleotide encoding a polypeptide as recited above, or a complement of such a polynucleotide. Within other embodiments, the amount of mRNA is detected using a hybridization technique, employing an oligonucleotide probe that hybridizes to a polynucleotide that encodes a polypeptide as recited above, or a complement of such a polynucleotide.

In related aspects, methods are provided for monitoring the progression of a cancer in a patient, comprising the steps of: (a) contacting a biological sample obtained from a patient with an oligonucleotide that hybridizes to a polynucleotide that encodes a lung tumor protein; (b) detecting in the sample an amount of a polynucleotide that hybridizes to the oligonucleotide; (c) repeating steps (a) and (b) using a biological sample obtained from the patient at a subsequent point in time; and (d) comparing the amount of polynucleotide detected in step (c) with the amount detected in step (b) and therefrom monitoring the progression of the cancer in the patient.

Within further aspects, the present invention provides antibodies, such as monoclonal antibodies, that bind to a polypeptide as described above, as well as diagnostic kits comprising such antibodies. Diagnostic kits comprising one or more oligonucleotide probes or primers as described above are also provided.

These and other aspects of the present invention will become apparent upon reference to the following detailed description. All references disclosed herein are hereby incorporated by reference in their entirety as if each was incorporated individually.

SEQUENCE IDENTIFIERS

SEQ ID NO: 1 is the determined cDNA sequence for clone #19038, also referred to as L845P.

SEQ ID NO: 2 is the determined cDNA sequence for clone #19036.

SEQ ID NO: 3 is the determined cDNA sequence for clone #19034.

SEQ ID NO: 4 is the determined cDNA sequence for clone #19033.

SEQ ID NO: 5 is the determined cDNA sequence for clone #19032.

SEQ ID NO: 6 is the determined cDNA sequence for clone #19030, also referred to as L559S.

SEQ ID NO: 7 is the determined cDNA sequence for clone #19029.

SEQ ID NO: 8 is the determined cDNA sequence for clone #19025.

SEQ ID NO: 9 is the determined cDNA sequence for clone #19023.

SEQ ID NO: 10 is the determined cDNA sequence for clone #18929.

SEQ ID NO: 11 is the determined cDNA sequence for clone #19010.

SEQ ID NO: 12 is the determined cDNA sequence for clone #19009.

SEQ ID NO: 13 is the determined cDNA sequence for clones #19005, 19007, 19016 and 19017.

SEQ ID NO: 14 is the determined cDNA sequence for clone #19004.

SEQ ID NO: 15 is the determined cDNA sequence for clones #19002 and 18965.

SEQ ID NO: 16 is the determined cDNA sequence for clone #18998.

SEQ ID NO: 17 is the determined cDNA sequence for clone #18997.

SEQ ID NO: 18 is the determined cDNA sequence for clone #18996.

SEQ ID NO: 19 is the determined cDNA sequence for clone #18995.

SEQ ID NO: 20 is the determined cDNA sequence for clone #18994, also known as L846P.

SEQ ID NO: 21 is the determined cDNA sequence for clone #18992.

SEQ ID NO: 22 is the determined cDNA sequence for clone #18991.

SEQ ID NO: 23 is the determined cDNA sequence for clone #18990, also referred to as clone #20111.

SEQ ID NO: 24 is the determined cDNA sequence for clone #18987.

SEQ ID NO: 25 is the determined cDNA sequence for clone #18985, also referred as L839P.

SEQ ID NO: 26 is the determined cDNA sequence for clone #18984, also referred to as L847P.

SEQ ID NO: 27 is the determined cDNA sequence for clone #18983.

SEQ ID NO: 28 is the determined cDNA sequence for clones #18976 and 18980.

SEQ ID NO: 29 is the determined cDNA sequence for clone #18975.

SEQ ID NO: 30 is the determined cDNA sequence for clone #18974.

SEQ ID NO: 31 is the determined cDNA sequence for clone #18973.

SEQ ID NO: 32 is the determined cDNA sequence for clone #18972.

SEQ ID NO: 33 is the determined cDNA sequence for clone #18971, also referred to as L801P.

SEQ ID NO: 34 is the determined cDNA sequence for clone #18970.

SEQ ID NO: 35 is the determined cDNA sequence for clone #18966.

SEQ ID NO: 36 is the determined cDNA sequence for clones #18964, 18968 and 19039.

SEQ ID NO: 37 is the determined cDNA sequence for clone #18960.

SEQ ID NO: 38 is the determined cDNA sequence for clone #18959.

SEQ ID NO: 39 is the determined cDNA sequence for clones #18958 and 18982.

SEQ ID NO: 40 is the determined cDNA sequence for clones #18956 and 19015.

SEQ ID NO: 41 is the determined cDNA sequence for clone #18954, also referred to L848P.

SEQ ID NO: 42 is the determined cDNA sequence for clone #18951.

SEQ ID NO: 43 is the determined cDNA sequence for clone #18950.

SEQ ID NO: 44 is the determined cDNA sequence for clones #18949 and 19024, also referred to as L844P.

SEQ ID NO: 45 is the determined cDNA sequence for clone #18948.

SEQ ID NO: 46 is the determined cDNA sequence for clone #18947, also referred to as L840P.

SEQ ID NO: 47 is the determined cDNA sequence for clones #18946, 18953, 18969 and 19027.

SEQ ID NO: 48 is the determined cDNA sequence for clone #18942.

SEQ ID NO: 49 is the determined cDNA sequence for clone #18940, 18962, 18963, 19006, 19008, 19000, and 19031.

SEQ ID NO: 50 is the determined cDNA sequence for clone #18939.

SEQ ID NO: 51 is the determined cDNA sequence for clones #18938 and 18952.

SEQ ID NO: 52 is the determined cDNA sequence for clone #18938.

SEQ ID NO: 53 is the determined cDNA sequence for clone #18937.

SEQ ID NO: 54 is the determined cDNA sequence for clones #18934, 18935, 18993 and 19022, also referred to as L548S.

SEQ ID NO: 55 is the determined CDNA sequence for clone #18932.

SEQ ID NO: 56 is the determined cDNA sequence for clones #18931 and 18936.

SEQ ID NO: 57 is the determined cDNA sequence for clone #18930.

SEQ ID NO: 58 is the determined CDNA sequence for clone #19014, also referred to as L773P.

SEQ ID NO: 59 is the determined CDNA sequence for clone #19127.

SEQ ID NO: 60 is the determined CDNA sequence for clones #19057 and 19064.

SEQ ID NO: 61 is the determined cDNA sequence for clone #19122.

SEQ ID NO: 62 is the determined cDNA sequence for clones #19120 and 18121.

SEQ ID NO: 63 is the determined CDNA sequence for clone #19118.

SEQ ID NO: 64 is the determined CDNA sequence for clone #19117.

SEQ ID NO: 65 is the determined cDNA sequence for clone #19116.

SEQ ID NO: 66 is the determined cDNA sequence for clone #19114.

SEQ ID NO: 67 is the determined CDNA sequence for clone #19112, also known as L561S.

SEQ ID NO: 68 is the determined cDNA sequence for clone #19110.

SEQ ID NO: 69 is the determined cDNA sequence for clone #19107, also referred to as L552S.

SEQ ID NO: 70 is the determined cDNA sequence for clone #19106, also referred to as L547S.

SEQ ID NO: 71 is the determined cDNA sequence for clones #19105 and 19111.

SEQ ID NO: 72 is the determined CDNA sequence for clone #19099.

SEQ ID NO: 73 is the determined cDNA sequence for clones #19095, 19104 and 19125, also referred to as L549S.

SEQ ID NO: 74 is the determined cDNA sequence for clone #19094.

SEQ ID NO: 75 is the determined cDNA sequence for clones #19089 and 19101.

SEQ ID NO: 76 is the determined cDNA sequence for clone #19088.

SEQ ID NO: 77 is the determined cDNA sequence for clones #19087, 19092, 19096, 19100 and 19119.

SEQ ID NO: 78 is the determined cDNA sequence for clone #19086.

SEQ ID NO: 79 is the determined CDNA sequence for clone #19085, also referred to as L550S.

SEQ ID NO: 80 is the determined cDNA sequence for clone #19084, also referred to as clone #19079.

SEQ ID NO: 81 is the determined cDNA sequence for clone #19082.

SEQ ID NO: 82 is the determined CDNA sequence for clone #19080.

SEQ ID NO: 83 is the determined CDNA sequence for clone #19077.

SEQ ID NO: 84 is the determined CDNA sequence for clone #19076, also referred to as L551S.

SEQ ID NO: 85 is the determined cDNA sequence for clone #19074, also referred to as clone #20102.

SEQ ID NO: 86 is the determined cDNA sequence for clone #19073, also referred to as L560S.

SEQ ID NO: 87 is the determined cDNA sequence for clones #19072 and 19115.

SEQ ID NO: 88 is the determined cDNA sequence for clone #19071.

SEQ ID NO: 89 is the determined cDNA sequence for clone #19070.

SEQ ID NO: 90 is the determined cDNA sequence for clone #19069.

SEQ ID NO: 91 is the determined cDNA sequence for clone #19068, also referred to L563S.

SEQ ID NO: 92 is the determined cDNA sequence for clone #19066.

SEQ ID NO: 93 is the determined cDNA sequence for lone #19065.

SEQ ID NO: 94 is the determined cDNA sequence for clone #19063.

SEQ ID NO: 95 is the determined cDNA sequence for clones #19061, 19081, 19108 and 19109.

SEQ ID NO: 96 is the determined cDNA sequence for clones #19060, 19067 and 19083, also referred to as L548S.

SEQ ID NO: 97 is the determined cDNA sequence for clones #19059 and 19062.

SEQ ID NO: 98 is the determined CDNA sequence for clone #19058.

SEQ ID NO: 99 is the determined cDNA sequence for clone #19124.

SEQ ID NO: 100 is the determined cDNA sequence for clone #18929.

SEQ ID NO: 101 is the determined cDNA sequence for clone #18422.

SEQ ID NO: 102 is the determined cDNA sequence for clone #18425.

SEQ ID NO: 103 is the determined cDNA sequence for clone #18431.

SEQ ID NO: 104 is the determined CDNA sequence for clone #18433.

SEQ ID NO: 105 is the determined cDNA sequence for clone #18444.

SEQ ID NO: 106 is the determined cDNA sequence for clone #18449.

SEQ ID NO: 107 is the determined cDNA sequence for clone #18451.

SEQ ID NO: 108 is the determined cDNA sequence for clone #18452.

SEQ ID NO: 109 is the determined cDNA sequence for clone #18455.

SEQ ID NO: 110 is the determined CDNA sequence for clone #18457.

SEQ ID NO: 111 is the determined cDNA sequence for clone #18466.

SEQ ID NO: 112 is the determined cDNA sequence for clone #18468.

SEQ ID NO: 113 is the determined cDNA sequence for clone #18471.

SEQ ID NO: 114 is the determined cDNA sequence for clone #18475.

SEQ ID NO: 115 is the determined cDNA sequence for clone #18476.

SEQ ID NO: 116 is the determined cDNA sequence for clone #18477.

SEQ ID NO: 117 is the determined cDNA sequence for clone #20631.

SEQ ID NO: 118 is the determined cDNA sequence for clone #20634.

SEQ ID NO: 119 is the determined cDNA sequence for clone #20635.

SEQ ID NO: 120 is the determined cDNA sequence for clone #20637.

SEQ ID NO: 121 is the determined cDNA sequence for clone #20638.

SEQ ID NO: 122 is the determined cDNA sequence for clone #20643.

SEQ ID NO: 123 is the determined cDNA sequence for clone #20652.

SEQ ID NO: 124 is the determined cDNA sequence for clone #20653.

SEQ ID NO: 125 is the determined cDNA sequence for clone #20657.

SEQ ID NO: 126 is the determined cDNA sequence for clone #20658.

SEQ ID NO: 127 is the determined cDNA sequence for clone #20660.

SEQ ID NO: 128 is the determined cDNA sequence for clone #20661.

SEQ ID NO: 129 is the determined cDNA sequence for clone #20663.

SEQ ID NO: 130 is the determined cDNA sequence for clone #20665.

SEQ ID NO: 132 is the determined cDNA sequence for clone #20670.

SEQ ID NO: 132 is the determined cDNA sequence for clone #20671.

SEQ ID NO: 133 is the determined cDNA sequence for clone #20672.

SEQ ID NO: 134 is the determined cDNA sequence for clone #20675.

SEQ ID NO: 135 is the determined CDNA sequence for clone #20679.

SEQ ID NO: 136 is the determined cDNA sequence for clone #20681.

SEQ ID NO: 137 is the determined cDNA sequence for clone #20682.

SEQ ID NO: 138 is the determined cDNA sequence for clone #20684.

SEQ ID NO: 139 is the determined cDNA sequence for clone #20685.

SEQ ID NO: 140 is the determined cDNA sequence for clone #20689.

SEQ ID NO: 141 is the determined cDNA sequence for clone #20699.

SEQ ID NO: 142 is the determined cDNA sequence for clone #20701.

SEQ ID NO: 143 is the determined cDNA sequence for clone #20702.

SEQ ID NO: 144 is the determined cDNA sequence for clone #20708.

SEQ ID NO: 145 is the determined cDNA sequence for clone #20715.

SEQ ID NO: 146 is the determined cDNA sequence for clone #20716.

SEQ ID NO: 147 is the determined cDNA sequence for clone #20719.

SEQ ID NO: 148 is the determined cDNA sequence for clone #19129.

SEQ ID NO: 149 is the determined cDNA sequence for clone #19131.1.

SEQ ID NO: 150 is the determined cDNA sequence for clone #19132.2.

SEQ ID NO: 151 is the determined cDNA sequence for clone #19133.

SEQ ID NO: 152 is the determined cDNA sequence for clone #19134.2.

SEQ ID NO: 153 is the determined cDNA sequence for clone #19135.2.

SEQ ID NO: 154 is the determined cDNA sequence for clone #19137.

SEQ ID NO: 155 is a first determined cDNA sequence for clone #19138.1.

SEQ ID NO: 156 is a second determined cDNA sequence for clone #19138.2.

SEQ ID NO: 157 is the determined cDNA sequence for clone #19139.

SEQ ID NO: 158 is a first determined cDNA sequence for clone #19140.1.

SEQ ID NO: 159 is a second determined cDNA sequence for clone #19140.2.

SEQ ID NO: 160 is the determined cDNA sequence for clone #19141.

SEQ ID NO: 161 is the determined cDNA sequence for clone #19143.

SEQ ID NO: 162 is the determined cDNA sequence for clone #19144.

SEQ ID NO: 163 is a first determined cDNA sequence for clone #19145.1.

SEQ ID NO: 164 is a second determined cDNA sequence for clone 145.2.

SEQ ID NO: 165 is the determined cDNA sequence for clone #19146.

SEQ ID NO: 166 is the determined cDNA sequence for clone # 19149.1.

SEQ ID NO: 167 is the determined cDNA sequence for clone #19152.

SEQ ID NO: 168 is a first determined cDNA sequence for clone #19153.1.

SEQ ID NO: 169 is a second determined cDNA sequence for clone 19153.2.

SEQ ID NO: 170 is the determined cDNA sequence for clone #19155.

SEQ ID NO: 171 is the determined cDNA sequence for clone #19157.

SEQ ID NO: 172 is the determined cDNA sequence for clone #19159.

SEQ ID NO: 173 is the determined cDNA sequence for clone 19160.

SEQ ID NO: 174 is a first determined cDNA sequence for clone #19161.1.

SEQ ID NO: 175 is a second determined cDNA sequence for clone #19161.2.

SEQ ID NO: 176 is the determined cDNA sequence for clone #19162.1.

SEQ ID NO: 177 is the determined cDNA sequence for clone #19166.

SEQ ID NO: 178 is the determined cDNA sequence for clone #19169.

SEQ ID NO: 179 is the determined cDNA sequence for clone #19171.

SEQ ID NO: 180 is a first determined cDNA sequence for clone #19173.1.

SEQ ID NO: 181 is a second determined cDNA sequence for clone #19173.2.

SEQ ID NO: 182 is the determined cDNA sequence for clone #19174.1.

SEQ ID NO: 183 is the determined cDNA sequence for clone #19175.

SEQ ID NO: 184 is the determined cDNA sequence for clone #19177.

SEQ ID NO: 185 is the determined cDNA sequence for clone #19178.

SEQ ID NO: 186 is the determined cDNA sequence for clone #19179.1.

SEQ ID NO: 187 is the determined cDNA sequence for clone #19179.2.

SEQ ID NO: 188 is the determined cDNA sequence for clone #19180.

SEQ ID NO: 189 is a first determined cDNA sequence for clone #19182.1.

SEQ ID NO: 190 is a second determined cDNA sequence for clone 19182.2.

SEQ ID NO: 191 is the determined cDNA sequence for clone #19183.1.

SEQ ID NO: 192 is the determined cDNA sequence for clone #19185.1.

SEQ ID NO: 193 is the determined cDNA sequence for clone #19187.

SEQ ID NO: 194 is the determined cDNA sequence for clone #19188.

SEQ ID NO: 195 is the determined cDNA sequence for clone #19190.

SEQ ID NO: 196 is the determined cDNA sequence for clone #19191.

SEQ ID NO: 197 is the determined cDNA sequence for clone #19192.

SEQ ID NO: 198 is the determined cDNA sequence for clone #19193.

SEQ ID NO: 199 is a first determined cDNA sequence for clone #19194. 1.

SEQ ID NO: 200 is a second determined cDNA sequence for clone #19194.2.

SEQ ID NO: 201 is the determined cDNA sequence for clone #19197.

SEQ ID NO: 202 is a first determined cDNA sequence for clone #19200.1.

SEQ ID NO: 203 is a second determined cDNA sequence for clone #19200.2.

SEQ ID NO: 204 is the determined cDNA sequence for clone #19202.

SEQ ID NO: 205 is a first determined cDNA sequence for clone #19204.1.

SEQ ID NO: 206 is a second determined cDNA sequence for clone #19204.2.

SEQ ID NO: 207 is the determined cDNA sequence for clone #19205.

SEQ ID NO: 208 is a first determined cDNA sequence for clone #19206.1.

SEQ ID NO: 209 is a second determined cDNA sequence for clone #19206.2.

SEQ ID NO: 210 is the determined cDNA sequence for clone #19207.

SEQ ID NO: 211 is the determined cDNA sequence for clone #19208.

SEQ ID NO: 212 is a first determined cDNA sequence for clone #19211.1.

SEQ ID NO: 213 is a second deter mined cDNA sequence for clone #19211.2.

SEQ ID NO: 214 is a first determined cDNA sequence for clone #19214.1.

SEQ ID NO: 215 is a second determined cDNA sequence for clone #19214.2.

SEQ ID NO: 216 is the determined CDNA sequence for clone #19215.

SEQ ID NO: 217 is a first determined cDNA sequence for clone #19217. 2.

SEQ ID NO: 218 is a second determined cDNA sequence for clone #19217.2.

SEQ ID NO: 219 is a first determined cDNA sequence for clone #19218.1.

SEQ ID NO: 220 is a second determined cDNA sequence for clone #19218.2.

SEQ ID NO: 221 is a first determined CDNA sequence for cone #19220.1.

SEQ ID NO: 222 is a second determined cDNA sequence for clone #19220.2.

SEQ ID NO: 223 is the determined CDNA sequence for clone #22015.

SEQ ID NO: 224 is the determined cDNA sequence for clone #22017.

SEQ ID NO: 225 is the determined cDNA sequence for clone #22019.

SEQ ID NO: 226 is the determined cDNA sequence for clone #22020.

SEQ ID NO: 227 is the determined cDNA sequence for clone #22023.

SEQ ID NO: 228 is the determined CDNA sequence for clone #22026.

SEQ ID NO: 229 is the determined CDNA sequence for clone #22027.

SEQ ID NO: 230 is the determined CDNA sequence for clone #22028.

SEQ ID NO: 231 is the determined cDNA sequence for clone #22032.

SEQ ID NO: 232 is the determined cDNA sequence for clone #22037.

SEQ ID NO: 233 is the determined cDNA sequence for clone #22045.

SEQ ID NO: 234 is the determined cDNA sequence for clone #22048.

SEQ ID NO: 235 is the determined cDNA sequence for clone #22050.

SEQ ID NO: 236 is the determined cDNA sequence for clone #22052.

SEQ ID NO: 237 is the determined cDNA sequence for clone #22053.

SEQ ID NO: 238 is the determined cDNA sequence for clone #22057.

SEQ ID NO: 239 is the determined cDNA sequence for clone #22066.

SEQ ID NO: 240 is the determined cDNA sequence for clone #22077.

SEQ ID NO: 241 is the determined cDNA sequence for clone #22085.

SEQ ID NO: 242 is the determined cDNA sequence for clone #22105.

SEQ ID NO: 243 is the determined cDNA sequence for clone #22108.

SEQ ID NO: 244 is the determined cDNA sequence for clone #22109.

SEQ ID NO: 245 is the determined cDNA sequence for clone #24842.

SEQ ID NO: 246 is the determined cDNA sequence for clone #24843.

SEQ ID NO: 247 is the determined cDNA sequence for clone #24845.

SEQ ID NO: 248 is the determined cDNA sequence for clone #24851.

SEQ ID NO: 249 is the determined cDNA sequence for clone #24852.

SEQ ID NO: 250 is the determined cDNA sequence for clone #24853.

SEQ ID NO: 251 is the determined cDNA sequence for clone #24854.

SEQ ID NO: 252 is the determined cDNA sequence for clone #24855.

SEQ ID NO: 253 is the determined cDNA sequence for clone #24860.

SEQ ID NO: 254 is the determined cDNA sequence for clone #24864.

SEQ ID NO: 255 is the determined cDNA sequence for clone #24866.

SEQ ID NO: 256 is the determined cDNA sequence for clone #24867.

SEQ ID NO: 257 is the determined cDNA sequence for clone #24868.

SEQ ID NO: 258 is the determined cDNA sequence for clone #24869.

SEQ ID NO: 259 is the determined cDNA sequence for clone #24870.
SEQ ID NO: 260 is the determined cDNA sequence for clone #24872.
SEQ ID NO: 261 is the determined cDNA sequence for clone #24873.
SEQ ID NO: 262 is the determined cDNA sequence for clone #24875.
SEQ ID NO: 263 is the determined cDNA sequence for clone #24882.
SEQ ID NO: 264 is the determined cDNA sequence for clone #24885.
SEQ ID NO: 265 is the determined cDNA sequence for clone #24886.
SEQ ID NO: 266 is the determined cDNA sequence for clone #24887.
SEQ ID NO: 267 is the determined cDNA sequence for clone #24888.
SEQ ID NO: 268 is the determined cDNA sequence for clone #24890.
SEQ ID NO: 269 is the determined cDNA sequence for clone #24896.
SEQ ID NO: 270 is the determined cDNA sequence for clone #24897.
SEQ ID NO: 271 is the determined cDNA sequence for clone #24899.
SEQ ID NO: 272 is the determined cDNA sequence for clone #24901.
SEQ ID NO: 273 is the determined cDNA sequence for clone #24902.
SEQ ID NO: 274 is the determined cDNA sequence for clone #24906.
SEQ ID NO: 275 is the determined cDNA sequence for clone #24912.
SEQ ID NO: 276 is the determined cDNA sequence for clone #24913.
SEQ ID NO: 277 is the determined cDNA sequence for clone #24920.
SEQ ID NO: 278 is the determined cDNA sequence for clone #24927.
SEQ ID NO: 279 is the determined cDNA sequence for clone #24930.
SEQ ID NO: 280 is the determined cDNA sequence for clone #26938.
SEQ ID NO: 281 is the determined cDNA sequence for clone #26939.
SEQ ID NO: 282 is the determined cDNA sequence for clone #26943.
SEQ ID NO: 283 is the determined cDNA sequence for clone #26948.
SEQ ID NO: 284 is the determined cDNA sequence for clone #26951.
SEQ ID NO: 285 is the determined cDNA sequence for clone #26955.
SEQ ID NO: 286 is the determined cDNA sequence for clone #26956.
SEQ ID NO: 287 is the determined cDNA sequence for clone #26959.
SEQ ID NO: 288 is the determined cDNA sequence for clone #26961.
SEQ ID NO: 289 is the determined cDNA sequence for clone #26962.
SEQ ID NO: 290 is the determined cDNA sequence for clone #26964.
SEQ ID NO: 291 is the determined cDNA sequence for clone #26966.
SEQ ID NO: 292 is the determined cDNA sequence for clone #26968.
SEQ ID NO: 293 is the determined cDNA sequence for clone #26972.
SEQ ID NO: 294 is the determined cDNA sequence for clone #26973.
SEQ ID NO: 295 is the determined cDNA sequence for clone #26974.
SEQ ID NO: 296 is the determined cDNA sequence for clone #26976.
SEQ ID NO: 297 is the determined cDNA sequence for clone #26977.
SEQ ID NO: 298 is the determined cDNA sequence for clone #26979.
SEQ ID NO: 299 is the determined cDNA sequence for clone #26980.
SEQ ID NO: 300 is the determined cDNA sequence for clone #26981.
SEQ ID NO: 301 is the determined cDNA sequence for clone #26984.
SEQ ID NO: 302 is the determined cDNA sequence for clone #26985.
SEQ ID NO: 303 is the determined cDNA sequence for clone #26986.
SEQ ID NO: 304 is the determined cDNA sequence for clone #26993.
SEQ ID NO: 305 is the determined cDNA sequence for clone #26994.
SEQ ID NO: 306 is the determined cDNA sequence for clone #26995.
SEQ ID NO: 307 is the determined cDNA sequence for clone #27003.
SEQ ID NO: 308 is the determined cDNA sequence for clone #27005.
SEQ ID NO: 309 is the determined cDNA sequence for clone #27010.
SEQ ID NO: 310 is the determined cDNA sequence for clone #27011.
SEQ ID NO: 311 is the determined cDNA sequence for clone #27013.
SEQ ID NO: 312 is the determined cDNA sequence for clone #27016
SEQ ID NO: 313 is the determined cDNA sequence for clone #27017.
SEQ ID NO: 314 is the determined cDNA sequence for clone #27019.
SEQ ID NO: 315 is the determined cDNA sequence for clone #27028.
SEQ ID NO: 316 is the full-length cDNA sequence for clone #19060.
SEQ ID NO: 317 is the full-length cDNA sequence for clone #18964.
SEQ ID NO: 318 is the fell-length cDNA sequence for clone #18929.
SEQ ID NO: 319 is the full-length cDNA sequence for clone #18991.
SEQ ID NO: 320 is the full-length cDNA sequence for clone #18996.

SEQ ID NO: 321 is the full-length cDNA sequence for clone #18966.

SEQ ID NO: 322 is the full-length cDNA sequence for clone #18951.

SEQ ID NO: 323 is the full-length cDNA sequence for clone #18973 (also known as L516S).

SEQ ID NO: 324 is the amino acid sequence for clone #19060.

SEQ ID NO: 325 is the amino acid sequence for clone #19063.

SEQ ID NO: 326 is the amino acid sequence for clone #19077.

SEQ ID NO: 327 is the amino acid sequence for clone #19110.

SEQ ID NO: 328 is the amino acid sequence for clone #19122.

SEQ ID NO: 329 is the amino acid sequence for clone #19118.

SEQ ID NO: 330 is the amino acid sequence for clone #19080.

SEQ ID NO: 331 is the amino acid sequence for clone #19127.

SEQ ID NO: 332 is the amino acid sequence for clone #19117.

SEQ ID NO: 333 is the amino acid sequence for clone #19095, also referred to L549S.

SEQ ID NO: 334 is the amino acid sequence for clone #18964.

SEQ ID NO: 335 is the amino acid sequence for clone #18929.

SEQ ID NO: 336 is the amino acid sequence for clone #18991.

SEQ ID NO: 337 is the amino acid sequence for clone #18996.

SEQ ID NO: 338 is the amino acid sequence for clone #18966.

SEQ ID NO: 339 is the amino acid sequence for clone #18951.

SEQ ID NO: 340 is the amino acid sequence for clone #18973.

SEQ ID NO: 341 is the determined cDNA sequence for clone 26461.

SEQ ID NO: 342 is the determined cDNA sequence for clone 26462.

SEQ ID NO: 343 is the determined cDNA sequence for clone 26463.

SEQ ID NO: 344 is the determined cDNA sequence for clone 26464.

SEQ ID NO: 345 is the determined cDNA sequence for clone 26465.

SEQ ID NO: 346 is the determined cDNA sequence for clone 26466.

SEQ ID NO: 347 is the determined cDNA sequence for clone 26467.

SEQ ID NO: 348 is the determined cDNA sequence for clone 26468.

SEQ ID NO: 349 is the determined cDNA sequence for clone 26469.

SEQ ID NO: 350 is the determined CDNA sequence for clone 26470.

SEQ ID NO: 351 is the determined cDNA sequence for clone 26471.

SEQ ID NO: 352 is the determined cDNA sequence for clone 26472.

SEQ ID NO: 353 is the determined cDNA sequence for clone 26474.

SEQ ID NO: 354 is the determined cDNA sequence for clone 26475.

SEQ ID NO: 355 is the determined cDNA sequence for clone 26476.

SEQ ID NO: 356 is the determined cDNA sequence for clone 26477.

SEQ ID NO: 357 is the determined cDNA sequence for clone 26478.

SEQ ID NO: 358 is the determined cDNA sequence for clone 26479.

SEQ ID NO: 359 is the determined cDNA sequence for clone 26480.

SEQ ID NO: 360 is the determined cDNA sequence for clone 26481.

SEQ ID NO: 361 is the determined cDNA sequence for clone 26482

SEQ ID NO: 362 is the determined cDNA sequence for clone 26483.

SEQ ID NO: 363 is the determined cDNA sequence for clone 26484.

SEQ ID NO: 364 is the determined cDNA sequence for clone 26485.

SEQ ID NO: 365 is the determined cDNA sequence for clone 26486.

SEQ ID NO: 366 is the determined cDNA sequence for clone 26487.

SEQ ID NO: 367 is the determined cDNA sequence for clone 26488.

SEQ ID NO: 368 is the determined cDNA sequence for clone 26489.

SEQ ID NO: 369 is the determined cDNA sequence for clone 26490.

SEQ ID NO: 370 is the determined cDNA sequence for clone 26491.

SEQ ID NO: 371 is the determined cDNA sequence for clone 26492.

SEQ ID NO: 372 is the determined cDNA sequence for clone 26493.

SEQ ID NO: 373 is the determined cDNA sequence for clone 26494.

SEQ ID NO: 374 is the determined cDNA sequence for clone 26495.

SEQ ID NO: 375 is the determined cDNA sequence for clone 26496.

SEQ ID NO: 376 is the determined cDNA sequence for clone 26497.

SEQ ID NO: 377 is the determined cDNA sequence for clone 26498.

SEQ ID NO: 378 is the determined cDNA sequence for clone 26499.

SEQ ID NO: 379 is the determined cDNA sequence for clone 26500.

SEQ ID NO: 380 is the determined cDNA sequence for clone 26501.

SEQ ID NO: 381 is the determined CDNA sequence for clone 26502.

SEQ ID NO: 382 is the determined cDNA sequence for clone 26503.

SEQ ID NO: 383 is the determined cDNA sequence for clone 26504.
SEQ ID NO: 384 is the determined cDNA sequence for clone 26505.
SEQ ID NO: 385 is the determined cDNA sequence for clone 26506.
SEQ ID NO: 386 is the determined cDNA sequence for clone 26507.
SEQ ID NO: 387 is the determined cDNA sequence for clone 26508.
SEQ ID NO: 388 is the determined cDNA sequence for clone 26509.
SEQ ID NO: 389 is the determined cDNA sequence for clone 26511.
SEQ ID NO: 390 is the determined cDNA sequence for clone 26513.
SEQ ID NO: 391 is the determined cDNA sequence for clone 26514.
SEQ ID NO: 392 is the determined cDNA sequence for clone 26515.
SEQ ID NO: 393 is the determined cDNA sequence for clone 26516.
SEQ ID NO: 394 is the determined cDNA sequence for clone 26517.
SEQ ID NO: 395 is the determined cDNA sequence for clone 26518.
SEQ ID NO: 396 is the determined cDNA sequence for clone 26519.
SEQ ID NO: 397 is the determined cDNA sequence for clone 26520.
SEQ ID NO: 398 is the determined cDNA sequence for clone 26521.
SEQ ID NO: 399 is the determined cDNA sequence for clone 26522.
SEQ ID NO: 400 is the determined cDNA sequence for clone 26523.
SEQ ID NO: 401 is the determined cDNA sequence for clone 26524.
SEQ ID NO: 402 is the determined cDNA sequence for clone 26526.
SEQ ID NO: 403 is the determined cDNA sequence for clone 26527.
SEQ ID NO: 404 is the determined cDNA sequence for clone 26528.
SEQ ID NO: 405 is the determined cDNA sequence for clone 26529.
SEQ ID NO: 406 is the determined cDNA sequence for clone 26530.
SEQ ID NO: 407 is the determined cDNA sequence for clone 26532.
SEQ ID NO: 408 is the determined CDNA sequence for clone 26533.
SEQ ID NO: 409 is the determined cDNA sequence for clone 26534.
SEQ ID NO: 410 is the determined cDNA sequence for clone 26535.
SEQ ID NO: 411 is the determined cDNA sequence for clone 26536.
SEQ ID NO: 412 is the determined cDNA sequence for clone 26537.
SEQ ID NO: 413 is the determined cDNA sequence for clone 26538.
SEQ ID NO: 414 is the determined cDNA sequence for clone 26540.
SEQ ID NO: 415 is the determined cDNA sequence for clone 26541.
SEQ ID NO: 416 is the determined cDNA sequence for clone 26542.
SEQ ID NO: 417 is the determined cDNA sequence for clone 26543.
SEQ ID NO: 418 is the determined cDNA sequence for clone 26544.
SEQ ID NO: 419 is the determined cDNA sequence for clone 26546.
SEQ ID NO: 420 is the determined cDNA sequence for clone 26547.
SEQ ID NO: 421 is the determined cDNA sequence for clone 26548.
SEQ ID NO: 422 is the determined cDNA sequence for clone 26549.
SEQ ID NO: 423 is the determined cDNA sequence for clone 26550.
SEQ ID NO: 424 is the determined cDNA sequence for clone 26551.
SEQ ID NO: 425 is the determined cDNA sequence for clone 26552.
SEQ ID NO: 426 is the determined cDNA sequence for clone 26553.
SEQ ID NO: 427 is the determined cDNA sequence for clone 26554.
SEQ ID NO: 428 is the determined cDNA sequence for clone 26556.
SEQ ID NO: 429 is the determined cDNA sequence for clone 26557.
SEQ ID NO: 430 is the determined cDNA sequence for clone 27631.
SEQ ID NO: 431 is the determined cDNA sequence for clone 27632.
SEQ ID NO: 432 is the determined cDNA sequence for clone 27633.
SEQ ID NO: 433 is the determined cDNA sequence for clone 27635.
SEQ ID NO: 434 is the determined cDNA sequence for clone 27636.
SEQ ID NO: 435 is the determined cDNA sequence for clone 27637.
SEQ ID NO: 436 is the determined cDNA sequence for clone 27638.
SEQ ID NO: 437 is the determined cDNA sequence for clone 27639.
SEQ ID NO: 438 is the determined cDNA sequence for clone 27640.
SEQ ID NO: 439 is the determined cDNA sequence for clone 27641.
SEQ ID NO: 440 is the determined CDNA sequence for clone 27642.
SEQ ID NO: 441 is the determined cDNA sequence for clone 27644.
SEQ ID NO: 442 is the determined cDNA sequence for clone 27646.
SEQ ID NO: 443 is the determined cDNA sequence for clone 27647.
SEQ ID NO: 444 is the determined cDNA sequence for clone 27649.

SEQ ID NO: 445 is the determined cDNA sequence for clone 27650.
SEQ ID NO: 446 is the determined cDNA sequence for clone 27651.
SEQ ID NO: 447 is the determined cDNA sequence for clone 27652.
SEQ ID NO: 448 is the determined cDNA sequence for clone 27654.
SEQ ID NO: 449 is the determined cDNA sequence for clone 27655.
SEQ ID NO: 450 is the determined cDNA sequence for clone 27657.
SEQ ID NO: 451 is the determined cDNA sequence for clone 27659.
SEQ ID NO: 452 is the determined cDNA sequence for clone 27665.
SEQ ID NO: 453 is the determined cDNA sequence for clone 27666.
SEQ ID NO: 454 is the determined cDNA sequence for clone 27668.
SEQ ID NO: 455 is the determined cDNA sequence for clone 27670.
SEQ ID NO: 456 is the determined cDNA sequence for clone 27671.
SEQ ID NO: 457 is the determined CDNA sequence for clone 27672.
SEQ ID NO: 458 is the determined cDNA sequence for clone 27674.
SEQ ID NO: 459 is the determined cDNA sequence for clone 27677.
SEQ ID NO: 460 is the determined cDNA sequence for clone 27681.
SEQ ID NO: 461 is the determined cDNA sequence for clone 27682.
SEQ ID NO: 462 is the determined cDNA sequence for clone 27683.
SEQ ID NO: 463 is the determined cDNA sequence for clone 27686.
SEQ ID NO: 464 is the determined cDNA sequence for clone 27688.
SEQ ID NO: 465 is the determined cDNA sequence for clone 27689.
SEQ ID NO: 466 is the determined cDNA sequence for clone 27690.
SEQ ID NO: 467 is the determined cDNA sequence for clone 27693.
SEQ ID NO: 468 is the determined cDNA sequence for clone 27699.
SEQ ID NO: 469 is the determined cDNA sequence for clone 27700.
SEQ ID NO: 470 is the determined cDNA sequence for clone 27702.
SEQ ID NO: 471 is the determined cDNA sequence for clone 27705.
SEQ ID NO: 472 is the determined cDNA sequence for clone 27706.
SEQ ID NO: 473 is the determined cDNA sequence for clone 27707.
SEQ ID NO: 474 is the determined cDNA sequence for clone 27708.
SEQ ID NO: 475 is the determined cDNA sequence for clone 27709.
SEQ ID NO: 476 is the determined cDNA sequence for clone 27710.
SEQ ID NO: 477 is the determined cDNA sequence for clone 27711.
SEQ ID NO: 478 is the determined cDNA sequence for clone 27712.
SEQ ID NO: 479 is the determined cDNA sequence for clone 27713.
SEQ ID NO: 480 is the determined cDNA sequence for clone 27714.
SEQ ID NO: 481 is the determined cDNA sequence for clone 27715.
SEQ ID NO: 482 is the determined cDNA sequence for clone 27716.
SEQ ID NO: 483 is the determined cDNA sequence for clone 27717.
SEQ ID NO: 484 is the determined cDNA sequence for clone 27718.
SEQ ID NO: 485 is the determined cDNA sequence for clone 27719.
SEQ ID NO: 486 is the determined cDNA sequence for clone 27720.
SEQ ID NO: 487 is the determined cDNA sequence for clone 27722.
SEQ ID NO: 488 is the determined cDNA sequence for clone 27723.
SEQ ID NO: 489 is the determined cDNA sequence for clone 27724.
SEQ ID NO: 490 is the determined cDNA sequence for clone 27726.
SEQ ID NO: 491 is the determined cDNA sequence for clone 25015.
SEQ ID NO: 492 is the determined cDNA sequence for clone 25016.
SEQ ID NO: 493 is the determined cDNA sequence for clone 25017.
SEQ ID NO: 494 is the determined cDNA sequence for clone 25018
SEQ ID NO: 495 is the determined cDNA sequence for clone 25030.
SEQ ID NO: 496 is the determined cDNA sequence for clone 25033.
SEQ ID NO: 497 is the determined cDNA sequence for clone 25034.
SEQ ID NO: 498 is the determined cDNA sequence for clone 25035.
SEQ ID NO: 499 is the determined cDNA sequence for clone 25036.
SEQ ID NO: 500 is the determined cDNA sequence for clone 25037.
SEQ ID NO: 501 is the determined cDNA sequence for clone 25038.
SEQ ID NO: 502 is the determined cDNA sequence for clone 25039.
SEQ ID NO: 503 is the determined cDNA sequence for clone 25040.
SEQ ID NO: 504 is the determined cDNA sequence for clone 25042.
SEQ ID NO: 505 is the determined cDNA sequence for clone 25043.
SEQ ID NO: 506 is the determined cDNA sequence for clone 25044.

SEQ ID NO: 507 is the determined cDNA sequence for clone 25045.
SEQ ID NO: 508 is the determined cDNA sequence for clone 25047.
SEQ ID NO: 509 is the determined cDNA sequence for clone 25048.
SEQ ID NO: 510 is the determined cDNA sequence for clone 25049.
SEQ ID NO: 511 is the determined cDNA sequence for clone 25185.
SEQ ID NO: 512 is the determined cDNA sequence for clone 25186.
SEQ ID NO: 513 is the determined cDNA sequence for clone 25187.
SEQ ID NO: 514 is the determined cDNA sequence for clone 25188.
SEQ ID NO: 515 is the determined cDNA sequence for clone 25189.
SEQ ID NO: 516 is the determined cDNA sequence for clone 25190.
SEQ ID NO: 517 is the determined cDNA sequence for clone 25193.
SEQ ID NO: 518 is the determined cDNA sequence for clone 25194.
SEQ ID NO: 519 is the determined cDNA sequence for clone 25196.
SEQ ID NO: 520 is the determined cDNA sequence for clone 25198.
SEQ ID NO: 521 is the determined cDNA sequence for clone 25199.
SEQ ID NO: 522 is the determined cDNA sequence for clone 25200.
SEQ ID NO: 523 is the determined cDNA sequence for clone 25202.
SEQ ID NO: 524 is the determined cDNA sequence for clone 25364.
SEQ ID NO: 525 is the determined cDNA sequence for clone 25366.
SEQ ID NO: 526 is the determined cDNA sequence for clone 25367.
SEQ ID NO: 527 is the determined cDNA sequence for clone 25368.
SEQ ID NO: 528 is the determined cDNA sequence for clone 25369.
SEQ ID NO: 529 is the determined cDNA sequence for clone 25370.
SEQ ID NO: 530 is the determined cDNA sequence for clone 25371.
SEQ ID NO: 531 is the determined cDNA sequence for clone 25372.
SEQ ID NO: 532 is the determined cDNA sequence for clone 25373.
SEQ ID NO: 533 is the determined cDNA sequence for clone 25374.
SEQ ID NO: 534 is the determined cDNA sequence for clone 25376.
SEQ ID NO: 535 is the determined cDNA sequence for clone 25377.
SEQ ID NO: 536 is the determined cDNA sequence for clone 25378.
SEQ ID NO: 537 is the determined cDNA sequence for clone 25379.
SEQ ID NO: 538 is the determined cDNA sequence for clone 25380.
SEQ ID NO: 539 is the determined cDNA sequence for clone 25381.
SEQ ID NO: 540 is the determined cDNA sequence for clone 25382.
SEQ ID NO: 541 is the determined cDNA sequence for clone 25383.
SEQ ID NO: 542 is the determined cDNA sequence for clone 25385.
SEQ ID NO: 543 is the determined cDNA sequence for clone 25386.
SEQ ID NO: 544 is the determined cDNA sequence for clone 25387.
SEQ ID NO: 545 is the determined cDNA sequence for clone 26013.
SEQ ID NO: 546 is the determined cDNA sequence for clone 26014.
SEQ ID NO: 547 is the determined cDNA sequence for clone 26016.
SEQ ID NO: 548 is the determined cDNA sequence for clone 26017.
SEQ ID NO: 549 is the determined cDNA sequence for clone 26018.
SEQ ID NO: 550 is the determined cDNA sequence for clone 26019.
SEQ ID NO: 551 is the determined cDNA sequence for clone 26020.
SEQ ID NO: 552 is the determined cDNA sequence for clone 26021.
SEQ ID NO: 553 is the determined CDNA sequence for clone 26022.
SEQ ID NO: 554 is the determined cDNA sequence for clone 26027.
SEQ ID NO: 555 is the determined cDNA sequence for clone 26197.
SEQ ID NO: 556 is the determined cDNA sequence for clone 26199.
SEQ ID NO: 557 is the determined cDNA sequence for clone 26201.
SEQ ID NO: 558 is the determined cDNA sequence for clone 26202.
SEQ ID NO: 559 is the determined cDNA sequence for clone 26203.
SEQ ID NO: 560 is the determined cDNA sequence for clone 26204.
SEQ ID NO: 561 is the determined cDNA sequence for clone 26205.
SEQ ID NO: 562 is the determined cDNA sequence for clone 26206.
SEQ ID NO: 563 is the determined cDNA sequence for clone 26208.
SEQ ID NO: 564 is the determined cDNA sequence for clone 26211.
SEQ ID NO: 565 is the determined cDNA sequence for clone 26212.
SEQ ID NO: 566 is the determined cDNA sequence for clone 26213.
SEQ ID NO: 567 is the determined cDNA sequence for clone 26214.
SEQ ID NO: 568 is the determined cDNA sequence for clone 26215.

SEQ ID NO: 569 is the determined .DNA sequence for clone 26216.
SEQ ID NO: 570 is the determined cDNA sequence for clone 26217.
SEQ ID NO: 571 is the determined cDNA sequence for clone 26218.
SEQ ID NO: 572 is the determined cDNA sequence for clone 26219.
SEQ ID NO: 573 is the determined cDNA sequence for clone 26220.
SEQ ID NO: 574 is the determined cDNA sequence for clone 26221.
SEQ ID NO: 575 is the determined cDNA sequence for clone 26224.
SEQ ID NO: 576 is the determined cDNA sequence for clone 26225.
SEQ ID NO: 577 is the determined cDNA sequence for clone 26226.
SEQ ID NO: 578 is the determined cDNA sequence for clone 26227.
SEQ ID NO: 579 is the determined cDNA sequence for clone 26228.
SEQ ID NO: 580 is the determined cDNA sequence for clone 26230.
SEQ ID NO: 581 is the determined cDNA sequence for clone 26231.
SEQ ID NO: 582 is the determined CDNA sequence for clone 26234.
SEQ ID NO: 583 is the determined cDNA sequence for clone 26236.
SEQ ID NO: 584 is the determined cDNA sequence for clone 26237.
SEQ ID NO: 585 is the determined cDNA sequence for clone 26239.
SEQ ID NO: 586 is the determined cDNA sequence for clone 26240.
SEQ ID NO: 587 is the determined cDNA sequence for clone 26241.
SEQ ID NO: 588 is the determined cDNA sequence for clone 26242.
SEQ ID NO: 589 is the determined cDNA sequence for clone 26246.
SEQ ID NO: 590 is the determined cDNA sequence for clone 26247.
SEQ ID NO: 591 is the determined cDNA sequence for clone 26248.
SEQ ID NO: 592 is the determined cDNA sequence for clone 26249.
SEQ ID NO: 593 is the determined cDNA sequence for clone 26250.
SEQ ID NO: 594 is the determined cDNA sequence for clone 26251.
SEQ ID NO, 595 is the determined cDNA sequence for clone 26252.
SEQ ID NO: 596 is the determined cDNA sequence for clone 26253.
SEQ ID NO: 597 is the determined cDNA sequence for clone 26254.
SEQ ID NO: 598 is the determined cDNA sequence for clone 26255.
SEQ ID NO: 599 is the determined cDNA sequence for clone 26256.
SEQ ID NO: 600 is the determined cDNA sequence for clone 26257.
SEQ ID NO: 601 is the determined cDNA sequence for clone 26259.
SEQ ID NO: 602 is the determined cDNA sequence for clone 26260.
SEQ ID NO: 603 is the determined cDNA sequence for clone 26261.
SEQ ID NO: 604 is the determined cDNA sequence for clone 26262.
SEQ ID NO: 605 is the determined cDNA sequence for clone 26263.
SEQ ID NO: 606 is the determined cDNA sequence for clone 26264.
SEQ ID NO: 607 is the determined cDNA sequence for clone 26265.
SEQ ID NO: 608 is the determined cDNA sequence for clone 26266.
SEQ ID NO: 609 is the determined cDNA sequence for clone 26268.
SEQ ID NO: 610 is the determined cDNA sequence for clone 26269.
SEQ ID NO: 611 is the determined CDNA sequence for clone 26271.
SEQ ID NO: 612 is the determined cDNA sequence for clone 26273.
SEQ ID NO: 613 is the determined cDNA sequence for clone 26810.
SEQ ID NO: 614 is the determined cDNA sequence for clone 26811.
SEQ ID NO: 615 is the determined cDNA sequence for clone 26812.1.
SEQ ID NO: 616 is the determined cDNA sequence for clone 26812.2.
SEQ ID NO: 617 is the determined cDNA sequence for clone 26813.
SEQ ID NO: 618 is the determined cDNA sequence for clone 26814.
SEQ ID NO: 619 is the determined cDNA sequence for clone 26815.
SEQ ID NO: 620 is the determined cDNA sequence for clone 26816.
SEQ ID NO: 621 is the determined cDNA sequence for clone 26818.
SEQ ID NO: 622 is the determined cDNA sequence for clone 26819.
SEQ ID NO: 623 is the determined cDNA sequence for clone 26820.
SEQ ID NO: 624 is the determined cDNA sequence for clone 26821.
SEQ ID NO: 625 is the determined cDNA sequence for clone 26822.
SEQ ID NO: 626 is the determined cDNA sequence for clone 26824.
SEQ ID NO: 627 is the determined CDNA sequence for clone 26825.
SEQ ID NO: 628 is the determined cDNA sequence for clone 26826.
SEQ ID NO: 629 is the determined cDNA sequence for clone 26827.
SEQ ID NO: 630 is the determined CDNA sequence for clone 26829.

SEQ ID NO: 631 is the determined ;DNA sequence for clone 26830.
SEQ ID NO: 632 is the determined cDNA sequence for clone 26831.
SEQ ID NO: 633 is the determined cDNA sequence for clone 26832.
SEQ ID NO: 634 is the determined cDNA sequence for clone 26835.
SEQ ID NO: 635 is the determined ,DNA sequence for clone 26836.
SEQ ID NO: 636 is the determined cDNA sequence for clone 26837.
SEQ ID NO: 637 is the determined cDNA sequence for clone 26839.
SEQ ID NO: 638 is the determined cDNA sequence for clone 26841.
SEQ ID NO: 639 is the determined cDNA sequence for clone 26843.
SEQ ID NO: 640 is the determined cDNA sequence for clone 26844.
SEQ ID NO: 641 is the determined cDNA sequence for clone 26845.
SEQ ID NO: 642 is the determined cDNA sequence for clone 26846.
SEQ ID NO: 643 is the determined cDNA sequence for clone 26847.
SEQ ID NO: 644 is the determined cDNA sequence for clone 26848.
SEQ ID NO: 645 is the determined cDNA sequence for clone 26849.
SEQ ID NO: 646 is the determined cDNA sequence for clone 26850.
SEQ ID NO: 647 is the determined cDNA sequence for clone 26851.
SEQ ID NO: 648 is the determined cDNA sequence for clone 26852.
SEQ ID NO: 649 is the determined cDNA sequence for clone 26853.
SEQ ID NO: 650 is the determined cDNA sequence for clone 26854.
SEQ ID NO: 651 is the determined cDNA sequence for clone 26856.
SEQ ID NO: 652 is the determined cDNA sequence for clone 26857.
SEQ ID NO: 653 is the determined cDNA sequence for clone 26858.
SEQ ID NO: 654 is the determined cDNA sequence for clone 26859.
SEQ ID NO: 655 is the determined cDNA sequence for clone 26860.
SEQ ID NO: 656 is the determined cDNA sequence for clone 26862.
SEQ ID NO: 657 is the determined cDNA sequence for clone 26863.
SEQ ID NO: 658 is the determined cDNA sequence for clone 26864.
SEQ ID NO: 659 is the determined cDNA sequence for clone 26865.
SEQ ID NO: 660 is the determined cDNA sequence for clone 26867.
SEQ ID NO: 661 is the determined cDNA sequence for clone 26868.
SEQ ID NO: 662 is the determined cDNA sequence for clone 26871.
SEQ ID NO: 663 is the determined cDNA sequence for clone 26873.
SEQ ID NO: 664 is the determined cDNA sequence for clone 26875.
SEQ ID NO: 665 is the determined cDNA sequence for clone 26876.
SEQ ID NO: 666 is the determined cDNA sequence for clone 26877.
SEQ ID NO: 667 is the determined cDNA sequence for clone 26878.
SEQ ID NO: 668 is the determined cDNA sequence for clone 26880.
SEQ ID NO: 669 is the determined cDNA sequence for clone 26882.
SEQ ID NO: 670 is the determined cDNA sequence for clone 26883.
SEQ ID NO: 671 is the determined cDNA sequence for clone 26884.
SEQ ID NO: 672 is the determined cDNA sequence for clone 26885.
SEQ ID NO: 673 is the determined cDNA sequence for clone 26886.
SEQ ID NO: 674 is the determined cDNA sequence for clone 26887.
SEQ ID NO: 675 is the determined cDNA sequence for clone 26888.
SEQ ID NO: 676 is the determined cDNA sequence for clone 26889.
SEQ ID NO: 677 is the determined cDNA sequence for clone 26890.
SEQ ID NO: 678 is the determined cDNA sequence for clone 26892.
SEQ ID NO: 679 is the determined cDNA sequence for clone 26894.
SEQ ID NO: 680 is the determined cDNA sequence for clone 26895.
SEQ ID NO: 681 is the determined cDNA sequence for clone 26897.
SEQ ID NO: 682 is the determined cDNA sequence for clone 26898.
SEQ ID NO: 683 is the determined cDNA sequence for clone 26899.
SEQ ID NO: 684 is the determined cDNA sequence for clone 26900.
SEQ ID NO: 685 is the determined cDNA sequence for clone 26901.
SEQ ID NO: 686 is the determined cDNA sequence for clone 26903.
SEQ ID NO: 687 is the determined cDNA sequence for clone 26905.
SEQ ID NO: 688 is the determined cDNA sequence for clone 26906.
SEQ ID NO: 689 is the determined cDNA sequence for clone 26708.
SEQ ID NO: 690 is the determined cDNA sequence for clone 26709.
SEQ ID NO: 691 is the determined cDNA sequence for clone 26710.
SEQ ID NO: 692 is the determined cDNA sequence for clone 26711.

SEQ ID NO: 693 is the determined cDNA sequence for clone 26712.
SEQ ID NO: 694 is the determined cDNA sequence for clone 26713.
SEQ ID NO: 695 is the determined cDNA sequence for clone 26714.
SEQ ID NO: 696 is the determined cDNA sequence for clone 26715.
SEQ ID NO: 697 is the determined cDNA sequence for clone 26716.
SEQ ID NO: 698 is the determined cDNA sequence for clone 26717.
SEQ ID NO: 699 is the determined cDNA sequence for clone 26718.
SEQ ID NO: 700 is the determined cDNA sequence for clone 26719.
SEQ ID NO: 701 is the determined cDNA sequence for clone 26720.
SEQ ID NO: 702 is the determined cDNA sequence for clone 26721.
SEQ ID NO: 703 is the determined cDNA sequence for clone 26722.
SEQ ID NO: 704 is the determined cDNA sequence for clone 26723.
SEQ ID NO: 705 is the determined cDNA sequence for clone 26724.
SEQ ID NO: 706 is the determined cDNA sequence for clone 26725.
SEQ ID NO: 707 is the determined cDNA sequence for clone 26726.
SEQ ID NO: 708 is the determined cDNA sequence for clone 26727.
SEQ ID NO: 709 is the determined cDNA sequence for clone 26728.
SEQ ID NO: 710 is the determined cDNA sequence for clone 26729.
SEQ ID NO: 711 is the determined cDNA sequence for clone 26730.
SEQ ID NO: 712 is the determined cDNA sequence for clone 26731.
SEQ ID NO: 713 is the determined cDNA sequence for clone 26732.
SEQ ID NO: 714 is the determined cDNA sequence for clone 26733.1.
SEQ ID NO: 715 is the determined cDNA sequence for clone 26733.2.
SEQ ID NO: 716 is the determined cDNA sequence for clone 26734.
SEQ ID NO: 717 is the determined cDNA sequence for clone 26735.
SEQ ID NO: 718 is the determined cDNA sequence for clone 26736.
SEQ ID NO: 719 is the determined cDNA sequence for clone 26737.
SEQ ID NO: 720 is the determined cDNA sequence for clone 26738.
SEQ ID NO: 721 is the determined cDNA sequence for clone 26739.
SEQ ID NO: 722 is the determined cDNA sequence for clone 26741.
SEQ ID NO: 723 is the determined cDNA sequence for clone 26742.
SEQ ID NO: 724 is the determined cDNA sequence for clone 26743.
SEQ ID NO: 725 is the determined cDNA sequence for clone 26744.
SEQ ID NO: 726 is the determined cDNA sequence for clone 26745.
SEQ ID NO: 727 is the determined cDNA sequence for clone 26746.
SEQ ID NO: 728 is the determined cDNA sequence for clone 26747.
SEQ ID NO: 729 is the determined cDNA sequence for clone 26748.
SEQ ID NO: 730 is the determined cDNA sequence for clone 26749.
SEQ ID NO: 731 is the determined cDNA sequence for clone 26750.
SEQ ID NO: 732 is the determined cDNA sequence for clone 26751.
SEQ ID NO: 733 is the determined cDNA sequence for clone 26752.
SEQ ID NO: 734 is the determined cDNA sequence for clone 26753.
SEQ ID NO: 735 is the determined cDNA sequence for clone 26754.
SEQ ID NO: 736 is the determined cDNA sequence for clone 26755.
SEQ ID NO: 737 is the determined cDNA sequence for clone 26756.
SEQ ID NO: 738 is the determined cDNA sequence for clone 26757.
SEQ ID NO: 739 is the determined cDNA sequence for clone 26758.
SEQ ID NO: 740 is the determined cDNA sequence for clone 26759.
SEQ ID NO: 741 is the determined cDNA sequence for clone 26760.
SEQ ID NO: 742 is the determined cDNA sequence for clone 26761.
SEQ ID NO: 743 is the determined cDNA sequence for clone 26762.
SEQ ID NO: 744 is the determined cDNA sequence for clone 26763.
SEQ ID NO: 745 is the determined cDNA sequence for clone 26764.
SEQ ID NO: 746 is the determined cDNA sequence for clone 26765.
SEQ ID NO: 747 is the determined cDNA sequence for clone 26766.
SEQ ID NO: 748 is the determined cDNA sequence for clone 26767.
SEQ ID NO: 749 is the determined cDNA sequence for clone 26768.
SEQ ID NO: 750 is the determined cDNA sequence for clone 26769.
SEQ ID NO: 751 is the determined cDNA sequence for clone 26770.
SEQ ID NO: 752 is the determined cDNA sequence for clone 26771.
SEQ ID NO: 753 is the determined cDNA sequence for clone 26772.
SEQ ID NO: 754 is the determined cDNA sequence for clone 26773.

SEQ ID NO: 755 is the determined cDNA sequence for clone 26774.

SEQ ID NO: 756 is the determined cDNA sequence for clone 26775.

SEQ ID NO: 757 is the determined cDNA sequence for clone 26776.

SEQ ID NO: 758 is the determined cDNA sequence for clone 26777.

SEQ ID NO: 759 is the determined cDNA sequence for clone 26778.

SEQ ID NO: 760 is the determined cDNA sequence for clone 26779.

SEQ ID NO: 761 is the determined cDNA sequence for clone 26781.

SEQ ID NO: 762 is the determined cDNA sequence for clone 26782.

SEQ ID NO: 763 is the determined cDNA sequence for clone 26783.

SEQ ID NO: 764 is the determined cDNA sequence for clone 26784.

SEQ ID NO: 765 is the determined cDNA sequence for clone 26785.

SEQ ID NO: 766 is the determined cDNA sequence for clone 26786.

SEQ ID NO: 767 is the determined cDNA sequence for clone 26787.

SEQ ID NO: 768 is the determined cDNA sequence for clone 26788.

SEQ ID NO: 769 is the determined cDNA sequence for clone 26790.

SEQ ID NO: 770 is the determined cDNA sequence for clone 26791.

SEQ ID NO: 771 is the determined cDNA sequence for clone 26792.

SEQ ID NO: 772 is the determined cDNA sequence for clone 26793.

SEQ ID NO: 773 is the determined cDNA sequence for clone 26794.

SEQ ID NO: 774 is the determined cDNA sequence for clone 26795.

SEQ ID NO: 775 is the determined cDNA sequence for clone 26796.

SEQ ID NO: 776 is the determined cDNA sequence for clone 26797.

SEQ ID NO: 777 is the determined cDNA sequence for clone 26798.

SEQ ID NO: 778 is the determined cDNA sequence for clone 26800.

SEQ ID NO: 779 is the determined cDNA sequence for clone 26801.

SEQ ID NO: 780 is the determined cDNA sequence for clone 26802.

SEQ ID NO: 781 is the determined cDNA sequence for clone 26803.

SEQ ID NO: 782 is the determined cDNA sequence for clone 26804.

SEQ ID NO: 783 is the amino acid sequence for L773P.

SEQ ID NO: 784 is the determined DNA sequence of the L773P expression construct.

SEQ ID NO: 785 is the determined DNA sequence of the L773PA expression construct.

SEQ ID NO: 786 is a predicted amino acid sequence for L552S.

SEQ ID NO: 787 is a predicted amino acid sequence for L840P.

SEQ ID NO: 788 is the full-length cDNA sequence for L548S.

SEQ ID NO: 789 is the amino acid sequence encoded by SEQ ID NO: 788.

SEQ ID NO: 790 is an extended cDNA sequence for L552S.

SEQ ID NO: 791 is the predicted amino acid sequence encoded by the cDNA sequence of

SEQ ID NO: 790.

SEQ ID NO: 792 is the determined cDNA sequence for an isoform of L552S.

SEQ ID NO: 793 is the predicted amino acid sequence encoded by SEQ ID NO: 792.

SEQ ID NO: 794 is an extended cDNA sequence for L840P.

SEQ ID NO: 795 is the predicted amino acid sequence encoded by SEQ DI NO: 794.

SEQ ID NO: 796 is an extended cDNA sequence for L801P.

SEQ ID NO: 797 is a first predicted amino acid sequence encoded by SEQ ID NO: 796.

SEQ ID NO: 798 is a second predicted amino acid sequence encoded by SEQ ID NO: 796.

SEQ ID NO: 799 is a third predicted amino acid sequence encoded by SEQ ID NO: 796.

SEQ ID NO: 800 is the determined full-length sequence for L844P.

SEQ ID NO: 801 is the 5' consensus cDNA sequence for L551S.

SEQ ID NO: 802 is the 3' consensus cDNA sequence for L551 S.

SEQ ID NO: 803 is the cDNA sequence for STY8.

SEQ ID NO: 804 is an extended cDNA sequence for L551S.

SEQ ID NO: 805 is the amino acid sequence for STY8.

SEQ ID NO: 806 is the extended amino acid sequence for L551S.

SEQ ID NO: 807 is the determined full-length CDNA sequence for L773P.

SEQ ID NO: 808 is the full-length CDNA sequence of L552S.

SEQ ID NO: 809 is the full-length amino acid sequence of L552S.

SEQ ID NO: 810 is the determined cDNA sequence of clone 50989.

SEQ ID NO: 811 is the determined cDNA sequence of clone 50990.

SEQ ID NO: 812 is the determined cDNA sequence of clone 50992.

SEQ ID NO: 813–824 are the determined cDNA sequences for clones isolated from lung tumor tissue.

SEQ ID NO: 825 is the determined cDNA sequence for the full-length L551S clone 54305.

SEQ ID NO: 826 is the determined cDNA sequence for the full-length L551S clone 54298.

SEQ ID NO: 827 is the full-length amino acid sequence for L551S.

Tables 1–6 contain the sequence identifiers for SEQ ID NO:878–1664.

TABLE 1A

| SEQ ID NO | CLONE IDENTIFIER |
|---|---|
| 828 | R0126:A02 |
| 829 | R0126:A03 |
| 830 | R0126:A05 |
| 831 | R0126:A06 |
| 832 | R0126:A08 |
| 833 | R0126:A09 |
| 834 | R0126:A10 |
| 835 | R0126:A11 |
| 836 | R0126:A12 |
| 837 | R0126:B01 |
| 838 | R0126:B03 |
| 839 | R0126:B04 |
| 840 | R0126:B05 |
| 841 | R0126:B06 |
| 842 | R0126:B07 |
| 843 | R0126:B08 |
| 844 | R0126:B09 |
| 845 | R0126:B11 |
| 846 | R0126:B12 |
| 847 | R0126:C01 |
| 848 | R0126:C02 |
| 849 | R0126:C03 |
| 850 | R0126:C05 |
| 851 | R0126:C06 |
| 852 | R0126:C07 |
| 853 | R0126:C08 |
| 854 | R0126:C09 |
| 855 | R0126:C10 |
| 856 | R0126:C11 |
| 857 | R0126:C12 |
| 858 | R0126:D01 |
| 859 | R0126:D02 |
| 860 | R0126:D03 |
| 861 | R0126:D04 |
| 862 | R0126:D05 |
| 863 | R0126:D06 |
| 864 | R0126:D07 |
| 865 | R0126:D08 |
| 866 | R0126:D09 |
| 867 | R0126:D10 |
| 868 | R0126:D11 |
| 869 | R0126:D12 |
| 870 | R0126:E01 |
| 871 | R0126:E02 |
| 872 | R0126:E03 |
| 873 | R0126:E04 |
| 874 | R0126:E05 |
| 875 | R0126:E06 |
| 876 | R0126:E07 |
| 877 | R0126:E08 |
| 878 | R0126:E09 |
| 879 | R0126:E10 |
| 880 | R0126:E11 |
| 881 | R0126:E12 |
| 882 | R0126:F01 |
| 883 | R0126:F02 |
| 884 | R0126:F03 |
| 885 | R0126:F04 |
| 886 | R0126:F05 |
| 887 | R0126:F06 |
| 888 | R0126:F07 |
| 889 | R0126:F08 |
| 890 | R0126:F10 |
| 891 | R0126:F11 |
| 892 | R0126:F12 |
| 893 | R0126:G01 |
| 894 | R0126:G02 |
| 895 | R0126:G03 |
| 896 | R0126:G04 |
| 897 | R0126:G05 |
| 898 | R0126:G06 |
| 899 | R0126:G07 |
| 900 | R0126:G09 |

TABLE 1A-continued

| SEQ ID NO | CLONE IDENTIFIER |
|---|---|
| 901 | R0126:G10 |
| 902 | R0126:G11 |
| 903 | R0126:G12 |
| 904 | R0126:H01 |
| 905 | R0126:H02 |
| 906 | R0126:H03 |
| 907 | R0126:H04 |
| 908 | R0126:H05 |
| 909 | R0126:H06 |

TABLE 1B

| SEQ ID NO | CLONE IDENTIFIER |
|---|---|
| 910 | R0126:H07 |
| 911 | R0126:H09 |
| 912 | R0126:H10 |
| 913 | R0126:H11 |
| 914 | R0127:A02 |
| 915 | R0127:A05 |
| 916 | R0127:A06 |
| 917 | R0127:A07 |
| 918 | R0127:A08 |
| 919 | R0127:A09 |
| 920 | R0127:A10 |
| 921 | R0127:A11 |
| 922 | R0127:A12 |
| 923 | R0127:B01 |
| 924 | R0127:B03 |
| 925 | R0127:B04 |
| 926 | R0127:B05 |
| 927 | R0127:B06 |
| 928 | R0127:B07 |
| 929 | R0127:B08 |
| 930 | R0127:B09 |
| 931 | R0127:B10 |
| 932 | R0127:B11 |
| 933 | R0127:B12 |
| 934 | R0127:C01 |
| 935 | R0127:C03 |
| 936 | R0127:C04 |
| 937 | R0127:C05 |
| 938 | R0127:C07 |
| 939 | R0127:C08 |
| 940 | R0127:C09 |
| 941 | R0127:C10 |
| 942 | R0127:C11 |
| 943 | R0127:D01 |
| 944 | R0127:D02 |
| 945 | R0127:D03 |
| 946 | R0127:D04 |
| 947 | R0127:D05 |
| 948 | R0127:D06 |
| 949 | R0127:D07 |
| 950 | R0127:D01 |
| 951 | R0127:D10 |
| 952 | R0127:D11 |
| 953 | R0127:D12 |
| 954 | R0127:E02 |
| 955 | R0127:E03 |
| 956 | R0127:E04 |
| 957 | R0127:E05 |
| 958 | R0127:E06 |
| 959 | R0127:E07 |
| 960 | R0127:E08 |
| 961 | R0127:E09 |
| 962 | R0127:E10 |
| 963 | R0127:E11 |
| 964 | R0127:F01 |
| 965 | R0127:F02 |
| 966 | R0127:F03 |
| 967 | R0127:F04 |

TABLE 1B-continued

| SEQ ID NO | CLONE IDENTIFIER |
|---|---|
| 968 | R0127:F05 |
| 969 | R0127:F06 |
| 970 | R0127:F07 |
| 971 | R0127:F08 |
| 972 | R0127:F10 |
| 973 | R0127:F11 |
| 974 | R0127:F12 |
| 975 | R0127:G01 |
| 976 | R0127:G02 |
| 977 | R0127:G03 |
| 978 | R0127:G04 |
| 979 | R0127:G05 |
| 980 | R0127:G06 |
| 981 | R0127:G07 |
| 982 | R0127:G08 |
| 983 | R0127:G09 |
| 984 | R0127:G10 |
| 985 | R0127:G11 |
| 986 | R0127:G12 |
| 987 | R0127:H01 |
| 988 | R0127:H02 |
| 989 | R0127:H03 |
| 990 | R0127:H04 |
| 991 | R0127:H05 |

TABLE 1C

| SEQ ID NO | CLONE IDENTIFIER |
|---|---|
| 992 | R0127:H06 |
| 993 | R0127:H07 |
| 994 | R0127:H08 |
| 995 | R1027:H09 |
| 996 | R1027:H10 |
| 997 | R1027:H11 |
| 998 | R1028:A02 |
| 999 | R1028:A05 |
| 1000 | R1028:A06 |
| 1001 | R1028:A07 |
| 1002 | R1028:A08 |
| 1003 | R1028:A09 |
| 1004 | R1028:A10 |
| 1005 | R1028:B01 |
| 1006 | R1028:B02 |
| 1007 | R1028:B03 |
| 1008 | R1028:B04 |
| 1009 | R1028:B05 |
| 1010 | R1028:B08 |
| 1011 | R1028:B09 |
| 1012 | R1028:B10 |
| 1013 | R1028:B11 |
| 1014 | R1028:B12 |
| 1015 | R1028:C01 |
| 1016 | R1028:C03 |
| 1017 | R1028:C04 |
| 1018 | R1028:C05 |
| 1019 | R1028:C06 |
| 1020 | R1028:C07 |
| 1021 | R1028:C08 |
| 1022 | R1028:C10 |
| 1023 | R1028:C11 |
| 1024 | R1028:C12 |
| 1025 | R1028:D01 |
| 1026 | R1028:D02 |
| 1027 | R1028:D04 |
| 1028 | R1028:D05 |
| 1029 | R1028:D06 |
| 1030 | R1028:D07 |
| 1031 | R1028:D08 |
| 1032 | R1028:D09 |
| 1033 | R0128:D10 |
| 1034 | R0128:D11 |

TABLE 1C-continued

| SEQ ID NO | CLONE IDENTIFIER |
|---|---|
| 1035 | R0128:D12 |
| 1036 | R0128:E01 |
| 1037 | R0128:E02 |
| 1038 | R0128:E03 |
| 1039 | R0128:E04 |
| 1040 | R0128:E05 |
| 1041 | R0128:E06 |
| 1042 | R0128:E07 |
| 1043 | R0128:E08 |
| 1044 | R0128:E09 |
| 1045 | R0128:E10 |
| 1046 | R0128:E12 |
| 1047 | R0128:F01 |
| 1048 | R0128:F02 |
| 1049 | R0128:F03 |
| 1050 | R0128:F04 |
| 1051 | R0128:F06 |
| 1052 | R0128:F07 |
| 1053 | R0128:F08 |
| 1054 | R0128:F09 |
| 1055 | R0128:F10 |
| 1056 | R0128:F12 |
| 1057 | R0128:G01 |
| 1058 | R0128:G02 |
| 1059 | R0128:G03 |
| 1060 | R0128:G04 |
| 1061 | R0128:G05 |
| 1062 | R0128:G06 |
| 1063 | R0128:G07 |
| 1064 | R0128:G09 |
| 1065 | R0128:G10 |
| 1066 | R0128:G11 |
| 1067 | R0128:G12 |
| 1068 | R0128:H01 |
| 1069 | R0128:H02 |
| 1070 | R0128:H03 |
| 1071 | R0128:H04 |
| 1072 | R0128:H05 |
| 1073 | R0128:H06 |
| 1074 | R0128:H07 |
| 1075 | R0128:H08 |

TABLE 1D

| SEQ ID NO | CLONE IDENTIFIER |
|---|---|
| 1076 | R0128:H09 |
| 1077 | R0128:H10 |
| 1078 | R0128:H11 |
| 1079 | R0130:A02 |
| 1080 | R0130:A05 |
| 1081 | R0130:A06 |
| 1082 | R0130:A08 |
| 1083 | R0130:A09 |
| 1084 | R0130:A10 |
| 1085 | R0130:A11 |
| 1086 | R0130:A12 |
| 1087 | R0130:B01 |
| 1088 | R0130:B02 |
| 1089 | R0130:B03 |
| 1090 | R0130:B04 |
| 1091 | R0130:B05 |
| 1092 | R0130:B06 |
| 1093 | R0130:B08 |
| 1094 | R0130:B09 |
| 1095 | R0130:B10 |
| 1096 | R0130:B11 |
| 1097 | R0130:B12 |
| 1098 | R0130:C02 |
| 1099 | R0130:C03 |
| 1100 | R0130:C04 |
| 1101 | R0130:C05 |

TABLE 1D-continued

| SEQ ID NO | CLONE IDENTIFIER |
|---|---|
| 1102 | R0130:C06 |
| 1103 | R0130:C07 |
| 1104 | R0130:C08 |
| 1105 | R0130:C09 |
| 1106 | R0130:C10 |
| 1107 | R0130:C11 |
| 1108 | R0130:C12 |
| 1109 | R0130:D02 |
| 1110 | R0130:D03 |
| 1111 | R0130:D04 |
| 1112 | R0130:D05 |
| 1113 | R0130:D06 |
| 1114 | R0130:D07 |
| 1115 | R0130:D09 |
| 1116 | R0130:D10 |
| 1117 | R0130:D11 |
| 1118 | R0130:D12 |
| 1119 | R0130:E01 |
| 1120 | R0130:E02 |
| 1121 | R0130:E03 |
| 1122 | R0130:E04 |
| 1123 | R0130:E05 |
| 1124 | R0130:E06 |
| 1125 | R0130:E07 |
| 1126 | R0130:E08 |
| 1127 | R0130:E09 |
| 1128 | R0130:E10 |
| 1129 | R0130:E11 |
| 1130 | R0130:E12 |
| 1131 | R0130:F02 |
| 1132 | R0130:F03 |
| 1133 | R0130:F05 |
| 1134 | R0130:F06 |
| 1135 | R0130:F07 |
| 1136 | R0130:F08 |
| 1137 | R0130:F09 |
| 1138 | R0130:F10 |
| 1139 | R0130:F11 |
| 1140 | R0130:F12 |
| 1141 | R0130:G01 |
| 1142 | R0130:G02 |
| 1143 | R0130:G03 |
| 1144 | R0130:G04 |
| 1145 | R0130:G05 |
| 1146 | R0130:G06 |
| 1147 | R0130:G07 |
| 1148 | R0130:G08 |
| 1149 | R0130:G09 |
| 1150 | R0130:G10 |
| 1151 | R0130:G11 |
| 1152 | R0130:G12 |
| 1153 | R0130:H01 |
| 1154 | R0130:H02 |
| 1155 | R0130:H04 |
| 1156 | R0130:H05 |
| 1157 | R0130:H06 |
| 1158 | R0130:H07 |
| 1159 | R0130:H08 |

TABLE 1E

| SEQ ID NO | CLONE IDENTIFIER |
|---|---|
| 1160 | R0130:H09 |
| 1161 | R0130:H10 |
| 1162 | R0130:H11 |
| 1163 | R0131:A02 |
| 1164 | R0131:A05 |
| 1165 | R0131:A06 |
| 1166 | R0131:A07 |
| 1167 | R0131:A08 |
| 1168 | R0131:A09 |
| 1169 | R0131:A11 |
| 1170 | R0131:A12 |
| 1171 | R0131:B02 |
| 1172 | R0131:B03 |
| 1173 | R0131:B04 |
| 1174 | R0131:B05 |
| 1175 | R0131:B07 |
| 1176 | R0131:B08 |
| 1177 | R0131:B09 |
| 1178 | R0131:B10 |
| 1179 | R0131:B11 |
| 1180 | R0131:C01 |
| 1181 | R0131:C02 |
| 1182 | R0131:C03 |
| 1183 | R0131:C04 |
| 1184 | R0131:C06 |
| 1185 | R0131:C07 |
| 1186 | R0131:C08 |
| 1187 | R0131:C10 |
| 1188 | R0131:C11 |
| 1189 | R0131:C12 |
| 1190 | R0131:D02 |
| 1191 | R0131:D03 |
| 1192 | R0131:D04 |
| 1193 | R0131:D05 |
| 1194 | R0131:D06 |
| 1195 | R0131:D07 |
| 1196 | R0131:D09 |
| 1197 | R0131:D10 |
| 1198 | R0131:D11 |
| 1199 | R0131:D12 |
| 1200 | R0131:E01 |
| 1201 | R0131:E02 |
| 1202 | R0131:E03 |
| 1203 | R0131:E04 |
| 1204 | R0131:E06 |
| 1205 | R0131:E07 |
| 1206 | R0131:E08 |
| 1207 | R0131:E10 |
| 1208 | R0131:E11 |
| 1209 | R0131:E12 |
| 1210 | R0131:F02 |
| 1211 | R0131:F04 |
| 1212 | R0131:F05 |
| 1213 | R0131:F06 |
| 1214 | R0131:F07 |
| 1215 | R0131:F08 |
| 1216 | R0131:F09 |
| 1217 | R0131:F10 |
| 1218 | R0131:F11 |
| 1219 | R0131:F12 |
| 1220 | R0131:G01 |
| 1221 | R0131:G02 |
| 1222 | R0131:G03 |
| 1223 | R0131:G04 |
| 1224 | R0131:G05 |
| 1225 | R0131:G06 |
| 1226 | R0131:G07 |
| 1227 | R0131:G08 |
| 1228 | R0131:G09 |
| 1229 | R0131:G10 |
| 1230 | R0131:G11 |
| 1231 | R0131:G12 |
| 1232 | R0131:H01 |
| 1233 | R0131:H02 |
| 1234 | R0131:H05 |
| 1235 | R0131:H06 |
| 1236 | R0131:H07 |
| 1237 | R0131:H08 |
| 1238 | R0131:H09 |
| 1239 | R0131:H11 |

TABLE 2

Clone names for NSCLC-SQL1 and corresponding SEQ ID NOs

| SEQ ID NO | CLONE IDENTIFIER |
|---|---|
| 1240 | Contig 54 |
| 1241 | Contig 55 |
| 1242 | Contig 57 |
| 1243 | Contig 58 |
| 1244 | Contig 60 |
| 1245 | Contig 62 |
| 1246 | Contig 63 |
| 1247 | Contig 64 |
| 1248 | Contig 65 |
| 1249 | Contig 66 |
| 1250 | Contig 67 |
| 1251 | Contig 68 |
| 1252 | Contig 69 |
| 1253 | Contig 70 |
| 1254 | Contig 71 |
| 1255 | Contig 72 |
| 1256 | Contig 73 |
| 1257 | Contig 74 |
| 1258 | Contig 75 |
| 1259 | Contig 77 |
| 1260 | Contig 78 |
| 1261 | Contig 79 |
| 1262 | Contig 80 |
| 1263 | Contig 81 |
| 1264 | Contig 83 |
| 1265 | Contig 84 |
| 1266 | Contig 86 |
| 1267 | Contig 87 |
| 1268 | Contig 88 |
| 1269 | Contig 89 |
| 1270 | Contig 90 |
| 1271 | Contig 91 |
| 1272 | Contig 92 |
| 1273 | Contig 94 |
| 1274 | Contig 95 |
| 1275 | Contig 96 |
| 1276 | Contig 97 |
| 1277 | Contig 98 |
| 1278 | Contig 99 |
| 1279 | Contig 100 |

TABLE 3

Clone names for NSCLC-SCLI and corresponding SEQ ID NOs

| SEQ ID NO | CLONE IDENTIFIER |
|---|---|
| 1280 | Contig 38 |
| 1281 | Contig 39 |
| 1282 | Contig 40 |
| 1283 | Contig 41 |
| 1284 | Contig 42 |
| 1285 | Contig 43 |
| 1286 | Contig 44 |
| 1287 | Contig 45 |
| 1288 | Contig 46 |
| 1289 | Contig 47 |
| 1290 | Contig 48 |
| 1291 | Contig 49 |
| 1292 | Contig 51 |
| 1293 | Contig 52 |
| 1294 | Contig 53 |
| 1295 | Contig 54 |
| 1296 | Contig 55 |
| 1297 | Contig 56 |
| 1298 | Contig 57 |
| 1299 | Contig 58 |
| 1300 | Contig 59 |
| 1301 | Contig 60 |

TABLE 3-continued

Clone names for NSCLC-SCLI and corresponding SEQ ID NOs

| SEQ ID NO | CLONE IDENTIFIER |
|---|---|
| 1302 | Contig 62 |
| 1303 | Contig 63 |
| 1304 | Contig 64 |
| 1305 | Contig 65 |
| 1306 | Contig 66 |
| 1307 | Contig 67 |
| 1308 | Contig 68 |
| 1309 | Contig 69 |
| 1310 | Contig 70 |
| 1311 | Contig 72 |
| 1312 | Contig 73 |
| 1313 | Contig 75 |
| 1314 | Contig 76 |
| 1315 | Contig 77 |
| 1316 | Contig 78 |
| 1317 | Contig 79 |
| 1318 | Contig 80 |
| 1319 | Contig 81 |
| 1320 | Contig 82 |

TABLE 4A

Clone names for NSCLC-SCL3-SCL4 and corresponding SEQ ID NOs

| SEQ ID NO | CLONE IDENTIFIER |
|---|---|
| 1321 | Contig 94 |
| 1322 | Contig 95 |
| 1323 | Contig 96 |
| 1324 | Contig 97 |
| 1325 | Contig 98 |
| 1326 | Contig 99 |
| 1327 | Contig 100 |
| 1328 | Contig 101 |
| 1329 | Contig 102 |
| 1330 | Contig 103 |
| 1331 | Contig 104 |
| 1332 | Contig 105 |
| 1333 | Contig 106 |
| 1334 | Contig 107 |
| 1335 | Contig 108 |
| 1336 | Contig 109 |
| 1337 | Contig 110 |
| 1338 | Contig 111 |
| 1339 | Contig 112 |
| 1340 | Contig 113 |
| 1341 | Contig 114 |
| 1342 | Contig 115 |
| 1343 | Contig 116 |
| 1344 | Contig 117 |
| 1345 | Contig 118 |
| 1346 | Contig 119 |
| 1347 | Contig 120 |
| 1348 | Contig 121 |
| 1349 | Contig 122 |
| 1350 | Contig 123 |
| 1351 | Contig 124 |
| 1352 | Contig 125 |
| 1353 | Contig 126 |
| 1354 | Contig 127 |
| 1355 | Contig 128 |
| 1356 | Contig 129 |
| 1357 | Contig 130 |
| 1358 | Contig 131 |
| 1359 | Contig 132 |
| 1360 | Contig 133 |
| 1361 | Contig 134 |
| 1362 | Contig 135 |
| 1363 | Contig 136 |

TABLE 4A-continued

Clone names for NSCLC-SCL3-SCL4 and corresponding SEQ ID NOs

| SEQ ID NO | CLONE IDENTIFIER |
|---|---|
| 1364 | Contig 137 |
| 1365 | Contig 138 |
| 1366 | Contig 139 |
| 1367 | Contig 140 |
| 1368 | Contig 141 |
| 1369 | Contig 142 |
| 1370 | Contig 143 |
| 1371 | Contig 144 |
| 1372 | Contig 145 |
| 1373 | Contig 146 |
| 1374 | Contig 147 |
| 1375 | Contig 148 |
| 1376 | Contig 149 |
| 1377 | Contig 150 |
| 1378 | Contig 151 |
| 1379 | Contig 152 |
| 1380 | Contig 153 |
| 1381 | Contig 154 |
| 1382 | Contig 155 |
| 1383 | Contig 156 |
| 1384 | Contig 157 |
| 1385 | Contig 158 |
| 1386 | Contig 159 |
| 1387 | Contig 160 |
| 1388 | Contig 161 |
| 1389 | Contig 162 |
| 1390 | Contig 163 |
| 1391 | Contig 164 |
| 1392 | Contig 165 |
| 1393 | Contig 166 |
| 1394 | Contig 167 |
| 1395 | Contig 168 |
| 1396 | Contig 169 |
| 1397 | Contig 170 |
| 1398 | Contig 171 |
| 1399 | Contig 172 |
| 1400 | Contig 173 |
| 1401 | Contig 174 |
| 1402 | Contig 175 |
| 1403 | Contig 176 |

TABLE 4B

Clone names for NSCLC-SCL3-SCL4 and corresponding SEQ ID NOs

| SEQ ID NO | CLONE IDENTIFIER |
|---|---|
| 1404 | Contig 177 |
| 1405 | Contig 178 |
| 1406 | Contig 179 |
| 1407 | Contig 180 |
| 1408 | Contig 181 |
| 1409 | Contig 182 |
| 1410 | Contig 183 |
| 1411 | Contig 184 |
| 1412 | Contig 185 |
| 1413 | Contig 186 |
| 1414 | Contig 187 |

TABLE 5

Clone names for SCLC-SQL1 and corresponding SEQ ID NOs

| SEQ ID NO | CLONE IDENTIFIER |
|---|---|
| 1415 | Contig 17 |
| 1416 | Contig 18 |
| 1417 | Contig 20 |
| 1418 | Contig 23 |
| 1419 | Contig 24 |
| 1420 | Contig 25 |
| 1421 | Contig 26 |
| 1422 | Contig 27 |
| 1423 | Contig 28 |
| 1424 | Contig 29 |
| 1425 | Contig 30 |
| 1426 | Contig 31 |
| 1427 | Contig 20 |
| 1428 | Contig 21 |
| 1429 | Contig 22 |
| 1430 | Contig 23 |
| 1431 | Contig 24 |
| 1432 | Contig 25 |
| 1433 | Contig 26 |
| 1434 | Contig 27 |
| 1435 | Contig 28 |
| 1436 | Contig 29 |
| 1437 | Contig 30 |
| 1438 | Contig 31 |
| 1439 | Contig 32 |
| 1440 | Contig 33 |
| 1441 | Contig 34 |
| 1442 | Contig 35 |
| 1443 | Contig 36 |
| 1444 | Contig 37 |
| 1445 | Contig 38 |

TABLE 6A

Clone names for SCLC-SCL3-SCL4 and corresponding SEQ ID NOs

| SEQ ID NO | CLONE IDENTIFIER |
|---|---|
| 1446 | Contig 116 |
| 1447 | Contig 117 |
| 1448 | Contig 118 |
| 1449 | Contig 119 |
| 1450 | Contig 120 |
| 1451 | Contig 122 |
| 1452 | Contig 123 |
| 1453 | Contig 124 |
| 1454 | Contig 125 |
| 1455 | Contig 126 |
| 1456 | Contig 127 |
| 1457 | Contig 128 |
| 1458 | Contig 129 |
| 1459 | Contig 130 |
| 1460 | Contig 131 |
| 1461 | Contig 132 |
| 1462 | Contig 133 |
| 1463 | Contig 135 |
| 1464 | Contig 136 |
| 1465 | Contig 137 |
| 1466 | Contig 138 |
| 1467 | Contig 139 (L985P) |
| 1468 | Contig 140 |
| 1469 | Contig 141 |
| 1470 | Contig 142 |
| 1471 | Contig 143 |
| 1472 | Contig 144 |
| 1473 | Contig 145 |
| 1474 | Contig 146 |

TABLE 6A-continued

Clone names for SCLC-SCL3-SCL4 and corresponding SEQ ID NOs

| SEQ ID NO | CLONE IDENTIFIER |
|---|---|
| 1475 | Contig 147 |
| 1476 | Contig 148 |
| 1477 | Contig 149 |
| 1478 | Contig 150 |
| 1479 | Contig 151 |
| 1480 | Contig 152 |
| 1481 | Contig 153 |
| 1482 | Contig 154 |
| 1483 | Contig 155 |
| 1484 | Contig 156 |
| 1485 | Contig 157 |
| 1486 | Contig 158 |
| 1487 | Contig 159 |
| 1488 | Contig 160 |
| 1489 | Contig 161 |
| 1490 | Contig 162 |
| 1491 | Contig 163 |
| 1492 | Contig 164 |
| 1493 | Contig 165 |
| 1494 | Contig 166 |
| 1495 | Contig 167 |
| 1496 | Contig 168 |
| 1497 | Contig 169 |
| 1498 | Contig 170 |
| 1499 | Contig 171 |
| 1500 | Contig 172 |
| 1501 | Contig 173 |
| 1502 | Contig 174 |
| 1503 | Contig 175 |
| 1504 | Contig 176 |
| 1505 | Contig 177 |
| 1506 | Contig 178 |
| 1507 | Contig 179 |
| 1508 | Contig 181 |
| 1509 | Contig 182 |
| 1510 | Contig 183 |
| 1511 | Contig 184 |
| 1512 | Contig 185 |
| 1513 | Contig 186 |
| 1514 | Contig 187 |
| 1515 | Contig 189 |
| 1516 | Contig 190 |
| 1517 | Contig 191 |
| 1518 | Contig 192 |
| 1519 | Contig 193 |
| 1520 | Contig 194 |
| 1521 | Contig 195 |
| 1522 | Contig 196 |
| 1523 | Contig 197 |
| 1524 | Contig 198 |
| 1525 | Contig 199 |
| 1526 | Contig 200 |
| 1527 | Contig 201 |
| 1528 | Contig 202 |

TABLE 6B

Clone names for SCLC-SCL3-SCL4 and corresponding SEQ ID NOs

| SEQ ID NO | CLONE IDENTIFIER |
|---|---|
| 1529 | Contig 203 |
| 1530 | Contig 204 |
| 1531 | Contig 205 |
| 1532 | Contig 206 |
| 1533 | Contig 207 |
| 1534 | Contig 208 |
| 1535 | Contig 209 |

TABLE 6B-continued

Clone names for SCLC-SCL3-SCL4 and corresponding SEQ ID NOs

| SEQ ID NO | CLONE IDENTIFIER |
|---|---|
| 1536 | Contig 210 |
| 1537 | Contig 211 |
| 1538 | Contig 212 |
| 1539 | Contig 213 |
| 1540 | Contig 214 |
| 1541 | Contig 215 |
| 1542 | Contig 216 |
| 1543 | Contig 217 |
| 1544 | Contig 218 |
| 1545 | Contig 219 |
| 1546 | Contig 220 |
| 1547 | Contig 221 |
| 1548 | Contig 222 |
| 1549 | Contig 223 |
| 1550 | Contig 224 |
| 1551 | Contig 225 |
| 1552 | Contig 226 |
| 1553 | Contig 227 |
| 1554 | Contig 228 |
| 1555 | Contig 229 |
| 1556 | Contig 230 |
| 1557 | Contig 231 |
| 1558 | Contig 232 |
| 1559 | Contig 233 |
| 1560 | Contig 234 |
| 1561 | Contig 235 |
| 1562 | Contig 236 |
| 1563 | Contig 237 |

TABLE 7

| SEQ ID NO | CLONE IDENTIFIER |
|---|---|
| 1564 | R0124:E05 |
| 1565 | R0124:E06 |
| 1566 | R0124:E08 |
| 1567 | R0124:F07 |
| 1568 | R0124:F08 |
| 1569 | R0124:F09 |
| 1570 | R0124:G04 |
| 1571 | R0129:A02 |
| 1572 | R0129:A03 |
| 1573 | R0129:A06 |
| 1574 | R0129:A07 |
| 1575 | R0129:A08 |
| 1576 | R0129:A09 |
| 1577 | R0129:A10 |
| 1578 | R0129:A11 |
| 1579 | R0129:A12 |
| 1580 | R0129:B02 |
| 1581 | R0129:B03 |
| 1582 | R0129:B04 |
| 1583 | R0129:B05 |
| 1584 | R0129:B06 |
| 1585 | R0129:B07 |
| 1586 | R0129:B08 |
| 1587 | R0129:B09 |
| 1588 | R0129:B10 |
| 1589 | R0129:B11 |
| 1590 | R0129:B12 |
| 1591 | R0129:C01 |
| 1592 | R0129:C02 |
| 1593 | R0129:C03 |
| 1594 | R0129:C04 |
| 1595 | R0129:C06 |
| 1596 | R0129:C07 |
| 1597 | R0129:C08 |
| 1598 | R0129:C09 |
| 1599 | R0129:C10 |

TABLE 7-continued

| SEQ ID NO | CLONE IDENTIFIER |
|---|---|
| 1600 | R0129:C11 |
| 1601 | R0129:C12 |
| 1602 | R0129:D01 |
| 1603 | R0129:D03 |
| 1604 | R0129:D04 |
| 1605 | R0129:D05 |
| 1606 | R0129:D06 |
| 1607 | R0129:D07 |
| 1608 | R0129:D08 |
| 1609 | R0129:D09 |
| 1610 | R0129:D10 |
| 1611 | R0129:D11 |
| 1612 | R0129:E02 |
| 1613 | R0129:E03 |
| 1614 | R0129:E04 |
| 1615 | R0129:E05 |
| 1616 | R0129:E06 |
| 1617 | R0129:E07 |
| 1618 | R0129:E08 |
| 1619 | R0129:E09 |
| 1620 | R0129:E11 |
| 1621 | R0129:E12 |
| 1622 | R0129:F01 |
| 1623 | R0129:F02 |
| 1624 | R0129:F03 |
| 1625 | R0129:F04 |
| 1626 | R0129:F06 |
| 1627 | R0129:F07 |
| 1628 | R0129:F08 |
| 1629 | R0129:F09 |
| 1630 | R0129:F10 |
| 1631 | R0129:F11 |
| 1632 | R0129:F12 |
| 1633 | R0129:G01 |
| 1634 | R0129:G02 |
| 1635 | R0129:G03 |
| 1636 | R0129:G04 |
| 1637 | R0129:G05 |
| 1638 | R0129:G06 |
| 1639 | R0129:G07 |
| 1640 | R0129:G08 |
| 1641 | R0129:G09 |
| 1642 | R0129:G10 |
| 1643 | R0129:G11 |
| 1644 | R0129:G12 |
| 1645 | R0129:H01 |
| 1646 | R0129:H02 |
| 1647 | R0129:H03 |
| 1648 | R0129:H04 |
| 1649 | R0129:H05 |
| 1650 | R0129:H08 |
| 1651 | R0129:H09 |
| 1652 | R0129:H10 |
| 1653 | R0129:H11 |

TABLE 8

| SEQ ID NO | CLONE IDENTIFIER |
|---|---|
| 1654 | 26484 |
| 1655 | 26496 |
| 1656 | 26517 |
| 1657 | 26531 |
| 1658 | 26022 |
| 1659 | 26026 |
| 1660 | 26810 |
| 1661 | 26815 |
| 1662 | 26869 |
| 1663 | 26883 |
| 1664 | 26902 |

SEQ ID NO:1667 is the protein sequence of expressed recombinant L7548S.

SEQ ID NO:1668 is the cDNA sequence of expressed recombinant L7548S.

SEQ ID NO: 1669 is the extended cDNA sequence of clone #18971 (L801P).

SEQ ID NO: 1670 is the amino acid sequence of open reading frame ORF4 encoded by SEQ ID NO:1669.

SEQ ID NO:1671 is the amino acid sequence of open reading frame ORF5 encoded by SEQ ID NO:1669.

SEQ ID NO: 1672 is the amino acid sequence of open reading frame ORF6 encoded by SEQ ID NO:1669.

SEQ ID NO: 1673 is the amino acid sequence of open reading frame ORF7 encoded by SEQ ID NO:1669.

SEQ ID NO:1674 is the amino acid sequence of open reading frame ORF8 encoded by SEQ ID NO:1669.

SEQ. ID NO: 1675 is the amino acid sequence of open reading frame ORF9 encoded by SEQ ID NO:1669.

SEQ ID NO:1676 is the extended cDNA for contig 139 (SEQ ID NO:1467), also known as L985P.

SEQ ID NO:1677 is the L985P amino acid sequence encoded by SEQ ID NO: 1676.

SEQ ID NO: 1678 is the amino acid sequence of open reading frame SEQ ID NO:1669.

SEQ ID NO: 1679 is the amino acid sequence of an open reading frame for (SEQ ID NO: 1467).

SEQ ID NOs: 1680–1788, set forth in the table below, represent cDNA clones identified by microarray analysis of the SQL1, SCL1, SCL3 and SCL4 libraries on lug chip 5.

| SEQ ID NO: | Clone Identifier |
|---|---|
| 1680 | 58456 |
| 1681 | 58458 |
| 1682 | 58462 |
| 1683 | 58469 |
| 1684 | 58470 |
| 1685 | 58482 |
| 1686 | 58485 |
| 1687 | 58501 |
| 1688 | 58502 |
| 1689 | 58505 |
| 1690 | 58507 |
| 1691 | 58509 |
| 1692 | 58512 |
| 1693 | 58527 |
| 1694 | 58529 |
| 1695 | 58531 |
| 1696 | 58537 |
| 1697 | 58539 |
| 1698 | 58545 |
| 1699 | 59319 |
| 1700 | 59322 |
| 1701 | 59348 |
| 1702 | 59350 |
| 1703 | 59363 |
| 1704 | 59365 |
| 1705 | 59370 |
| 1706 | 59373 |
| 1707 | 59376 |
| 1708 | 61050 |
| 1709 | 61051 |
| 1710 | 61052 |
| 1711 | 61054 |
| 1712 | 61056 |
| 1713 | 61057 |
| 1714 | 61060 |
| 1715 | 61062 |
| 1716 | 61063 |
| 1717 | 61064 |
| 1718 | 61065 |

-continued

| SEQ ID NO: | Clone Identifier |
|---|---|
| 1719 | 61066 |
| 1720 | 61069 |
| 1721 | 61070 |
| 1722 | 61071 |
| 1723 | 61074 |
| 1724 | 61075 |
| 1725 | 61077 |
| 1726 | 61079 |
| 1727 | 61080 |
| 1728 | 61081 |
| 1729 | 61083 |
| 1730 | 61085 |
| 1731 | 61086 |
| 1732 | 61088 |
| 1733 | 61090 |
| 1734 | 61091 |
| 1735 | 61093 |
| 1736 | 61094 |
| 1737 | 61096 |
| 1738 | 61097 |
| 1739 | 61099 |
| 1740 | 61100 |
| 1741 | 61103 |
| 1742 | 61105 |
| 1743 | 61106 |
| 1744 | 61110 |
| 1745 | 61113 |
| 1746 | 61115 |
| 1747 | 61117 |
| 1748 | 61118 |
| 1749 | 61119 |
| 1750 | 61120 |
| 1751 | 61122 |
| 1752 | 61125 |
| 1753 | 61126 |
| 1754 | 61130 |
| 1755 | 61133 |
| 1756 | 61134 |
| 1757 | 61135 |
| 1758 | 61137 |
| 1759 | 61139 |
| 1760 | 61143 |
| 1761 | 61144 |
| 1762 | 61148 |
| 1763 | 61151 |
| 1764 | 61155 |
| 1765 | 61156 |
| 1766 | 61159 |
| 1767 | 61160 |
| 1768 | 61163 |
| 1769 | 61167 |
| 1770 | 61172 |
| 1771 | 61173 |
| 1772 | 61176 |
| 1773 | 61177 |
| 1774 | 61183 |
| 1775 | 61185 |
| 1776 | 61188 |
| 1777 | 61192 |
| 1778 | 61198 |
| 1779 | 61201 |
| 1780 | 61202 |
| 1781 | 61204 |
| 1782 | 61206 |
| 1783 | 61210 |
| 1784 | 61212 |
| 1785 | 61216 |
| 1786 | 61225 |
| 1787 | 61226 |
| 1788 | 61227 |

SEQ ID NO: 1789 is the cDNA sequence of clone #47988 (L972P).

SEQ ID NO: 1790 is the cDNA sequence of clone #48005 (L979P).

SEQ ID NO: 1791 is an extended cDNA sequence for clone #48005 (L979P).

SEQ ID NO: 1792 is an extended cDNA sequence for clone #49826 (SEQ ID NO: 79; L980P).

SEQ ID NO: 1793 is an extended cDNA sequence for clone #20631 (SEQ ID NO: 117; L973P).

SEQ ID NO: 1794 is an extended cDNA sequence for clone #20661 (SEQ ID NO:128; L974P).

SEQ ID NO:1795 is an extended cDNA sequence for clone #50430 (SEQ ID NO:1442; L996P).

SEQ ID NO:1796 is an extended cDNA sequence for clone #26961 (SEQ ID NO:288; L977P).

SEQ ID NO:1797 is an extended cDNA sequence for clone #24928 (SEQ ID NO: 1339; L978P).

SEQ ID NO:1798 is an extended cDNA sequence for clone #50507 (SEQ ID NO:1446; L984P).

SEQ ID NO:1799 is an extended cDNA sequence for clone #50645 (SEQ ID NO:1531; L988P).

SEQ ID NO: 1800 is an extended cDNA sequence for clone #50628 (SEQ ID NO:1533; L1423P).

SEQ ID NO: 1801 is an extended cDNA sequence for clone #50560 (SEQ ID NO: 1527; L987P).

SEQ ID NO: 1802 is an extended cDNA sequence for clone #27699 (SEQ ID NO:468; L998P).

SEQ ID NO:1803 is an extended cDNA sequence for clone #59303 (SEQ ID NO:949; L1425P).

SEQ ID NO: 1804 is an extended cDNA sequence for clone #59314 (SEQ ID NO: 1156; L1426P).

SEQ ID NO: 1805 is an extended cDNA sequence for clone #59298 (SEQ ID NO:921; L1427P).

SEQ ID NO: 1806 is an amino acid sequence encoded by SEQ ID NO:1791.

SEQ ID NO: 1807 is an amino acid sequence encoded by SEQ ID NO: 1792.

SEQ ID NO: 1808 is an amino acid sequence encoded by SEQ ID NO:1793.

SEQ ID NO: 1809 is an amino acid sequence encoded by SEQ ID NO:1794.

SEQ ID NO: 1810 is an amino acid sequence encoded by SEQ ID NO:1795.

SEQ ID NO: 1811 is an amino acid sequence encoded by SEQ ID NO:1796.

SEQ ID NO: 1812 is an amino acid sequence encoded by SEQ ID NO:1797.

SEQ ID NO: 1813 is an amino acid sequence encoded by SEQ ID NO:1798.

SEQ ID NO: 1814 is an amino acid sequence encoded by SEQ ID NO:1799.

SEQ ID NO: 1815 is an amino acid sequence encoded by SEQ ID NO:1800.

SEQ ID NO: 1816 is an amino acid sequence encoded by SEQ ID NO: 1527 (L987P).

SEQ ID NO: 1817 is an amino acid sequence encoded by SEQ ID NO:1823.

SEQ ID NO: 1818 is an amino acid sequence encoded by SEQ ID NO:1801.

SEQ ID NO: 1819 is an amino acid sequence encoded by SEQ ID NO:1802.

SEQ ID NO: 1820 is an amino acid sequence encoded by SEQ ID NO: 1803.

SEQ ID NO: 1821 is an amino acid sequence encoded by SEQ ID NO: 1804.

SEQ ID NO: 1822 is an amino acid sequence encoded by SEQ ID NO:1805.

SEQ ID NO: 1823 is an extended cDNA sequence for clone #50560 (SEQ ID NO: 1527; L987P).

SEQ ID NO: 1824 is an extended, full length cDNA sequence for clone L872P (SEQ ID NO:34).

SEQ ID NO: 1825 is the amino acid sequence encoded by SEQ ID NO:1824.

DETAILED DESCRIPTION OF THE INVENTION

As noted above, the present invention is generally directed to compositions and methods for using the compositions, for example in the therapy and diagnosis of cancer, such as lung cancer. Certain illustrative compositions described herein include lung tumor polypeptides, polynucleotides encoding such polypeptides, binding agents such as antibodies, antigen presenting cells (APCs) and/or immune system cells (e.g., T cells). A "lung tumor protein," as the term is used herein, refers generally to a protein that is expressed in lung tumor cells at a level that is at least two fold, and preferably at least five fold, greater than the level of expression in a normal tissue, as determined using a representative assay provided herein. Certain lung tumor proteins are tumor proteins that react detectably (within an immunoassay, such as an ELISA or Western blot) with antisera of a patient afflicted with lung cancer.

Therefore, in accordance with the above, and as described further below, the present invention provides illustrative polynucleotide compositions having sequences set forth in SEQ ID NO: 1–323, 341–782, 784–785, 788, 790, 792, 794, 796, 800–804, 807, 808, 810–826, 878–1664, 1668, 1669, 1676, 1680–1805, and 1824 illustrative polypeptide compositions having amino acid sequences set forth in SEQ ID NO: 324–340, 783, 786, 787, 789, 791, 793, 795, 797–799, 805, 806, 809, 827, 1667, 1670–1675, 1677–1679, 1806–1822 and 1825 antibody compositions capable of binding such polypeptides, and numerous additional embodiments employing such compositions, for example in the detection, diagnosis and/or therapy of human lung cancer.

POLYNUCLEOTIDE COMPOSITIONS

As used herein, the terms "DNA segment" and "polynucleotide" refer to a DNA molecule that has been isolated free of total genomic DNA of a particular species. Therefore, a DNA segment encoding a polypeptide refers to a DNA segment that contains one or more coding sequences yet is substantially isolated away from, or purified free from, total genomic DNA of the species from which the DNA segment is obtained. Included within the terms "DNA segment" and "polynucleotide" are DNA segments and smaller fragments of such segments, and also recombinant vectors, including, for example, plasmids, cosmids, phagemids, phage, viruses, and the like.

As will be understood by those skilled in the art, the DNA segments of this invention can include genomic sequences, extra-genomic and plasmid-encoded sequences and smaller engineered gene segments that express, or may be adapted to express, proteins, polypeptides, peptides and the like. Such segments may be naturally isolated, or modified synthetically by the hand of man.

"Isolated," as used herein, means that a polynucleotide is substantially away from other coding sequences, and that the DNA segment does not contain large portions of unrelated coding DNA, such as large chromosomal fragments or other functional genes or polypeptide coding regions. Of course, this refers to the DNA segment as originally isolated, and does not exclude genes or coding regions later added to the segment by the hand of man.

As will be recognized by the skilled artisan, polynucleotides may be single-stranded (coding or antisense) or double-stranded, and may be DNA (genomic, cDNA or synthetic) or RNA molecules. RNA molecules include HnRNA molecules, which contain introns and correspond to a DNA molecule in a one-to-one manner, and mRNA molecules, which do not contain introns. Additional coding or non-coding sequences may, but need not, be present within a polynucleotide of the present invention, and a polynucleotide may, but need not, be linked to other molecules and/or support materials.

Polynucleotides may comprise a native sequence (i.e., an endogenous sequence that encodes a lung tumor protein or a portion thereof) or may comprise a variant, or a biological or antigenic functional equivalent of such a sequence. Polynucleotide variants may contain one or more substitutions, additions, deletions and/or insertions, as further described below, preferably such that the immunogenicity of the encoded polypeptide is not diminished, relative to a native tumor protein. The effect on the immunogenicity of the encoded polypeptide may generally be assessed as described herein. The term "variants" also encompasses homologous genes of xenogenic origin.

When comparing polynucleotide or polypeptide sequences, two sequences are said to be "identical" if the sequence of nucleotides or amino acids in the two sequences is the same when aligned for maximum correspondence, as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, 40 to about 50, in which a sequence may be compared to a reference sequence of the same number of contiguous positions after the two sequences are optimally aligned.

Optimal alignment of sequences for comparison may be conducted using the Megalign program in the Lasergene suite of bioinformatics software (DNASTAR, Inc., Madison, Wis.), using default parameters. This program embodies several alignment schemes described in the following references: Dayhoff, M. O. (1978) A model of evolutionary change in proteins—Matrices for detecting distant relationships. In Dayhoff, M. O. (ed.) Atlas of Protein Sequence and Structure, National Biomedical Research Foundation, Washington D.C. Vol. 5, Suppl. 3, pp. 345–358; Hein J. (1990) Unified Approach to Alignment and Phylogenes pp. 626–645 *Methods in Enzymology* vol. 183, Academic Press, Inc., San Diego, Calif.; Higgins, D. G. and Sharp, P. M. (1989) *CABIOS* 5:151–153; Myers, E. W. and Muller W. (1988) *CABIOS* 4:11–17; Robinson, E. D. (1971) *Comb. Theor* 11:105; Santou, N. Nes, M. (1987) *Mol. Biol. Evol.* 4:406–425; Sneath, P. H. A. and Sokal, R. R. (1973) *Numerical Taxonomy—the Principles and Practice of Numerical Taxonomy*, Freeman Press, San Francisco, Calif.; Wilbur, W. J. and Lipman, D. J. (1983) *Proc. Natl. Acad., Sci. USA* 80:726–730.

Alternatively, optimal alignment of sequences for comparison may be conducted by the local identity algorithm of Smith and Waterman (1981) *Add. APL. Math* 2:482, by the identity alignment algorithm of Needleman and Wunsch (1970) *J. Mol. Biol.* 48:443, by the search for similarity methods of Pearson and Lipman (1988) *Proc. Natl. Acad. Sci. USA* 85: 2444, by computerized implementations of these algorithms (GAP, BESTFIT, BLAST, FASTA, and TFASTA in the Wisconsin Genetics Software Package, Genetics Computer Group (GCG), 575 Science Dr., Madison, Wis.), or by inspection.

One preferred example of algorithms that are suitable for determining percent sequence identity and sequence similarity are the BLAST and BLAST 2.0 algorithms, which are described in Altschul et al. (1977) *Nucl. Acids Res.* 25:3389–3402 and Altschul et al. (1990) *J. Mol. Biol.* 215:403–410, respectively. BLAST and BLAST 2.0 can be used, for example with the parameters described herein, to determine percent sequence identity for the polynucleotides and polypeptides of the invention. Software for performing BLAST analyses is publicly available through the National Center for Biotechnology Information. In one illustrative example, cumulative scores can be calculated using, for nucleotide sequences, the parameters M (reward score for a pair of matching residues; always >0) and N (penalty score for mismatching residues; always <0). For amino acid sequences, a scoring matrix can be used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a wordlength (W) of 11, and expectation (E) of 10, and the BLOSUM62 scoring matrix (see Henikoff and Henikoff (1989) *Proc. Natl. Acad. Sci. USA* 89:10915) alignments, (B) of 50, expectation (E) of 10, M=5, N=−4 and a comparison of both strands.

Preferably, the "percentage of sequence identity" is determined by comparing two optimally aligned sequences over a window of comparison of at least 20 positions, wherein the portion of the polynucleotide or polypeptide sequence in the comparison window may comprise additions or deletions (i.e., gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical nucleic acid bases or amino acid residue occurs in both sequences to yield the number of matched positions, dividing the number of matched positions by the total number of positions in the reference sequence (i.e., the window size) and multiplying the results by 100 to yield the percentage of sequence identity.

Therefore, the present invention encompasses polynucleotide and polypeptide sequences having substantial identity to the sequences disclosed herein, for example those comprising at least 50% sequence identity, preferably at least 55%, 60%, 65%, 70%, 75%, 80%, 85%, 90%, 95%, 96%, 97%, 98%, or 99% or higher, sequence identity compared to a polynucleotide or polypeptide sequence of this invention using the methods described herein, (e.g., BLAST analysis using standard parameters, as described below). One skilled in this art will recognize that these values can be appropriately adjusted to determine corresponding identity of proteins encoded by two nucleotide sequences by taking into account codon degeneracy, amino acid similarity, reading frame positioning and the like.

In additional embodiments, the present invention provides isolated polynucleotides and polypeptides comprising various lengths of contiguous stretches of sequence identical to or complementary to one or more of the sequences disclosed herein. For example, polynucleotides are provided by this invention that comprise at least about 15, 20, 30, 40, 50, 75, 100, 150, 200, 300, 400, 500 or 1000 or more contiguous nucleotides of one or more of the sequences disclosed herein as well as all intermediate lengths there between. It will be readily understood that "intermediate lengths", in this context, means any length between the quoted values, such as 16, 17, 18, 19, etc.; 21, 22, 23, etc.; 30, 31, 32, etc.; 50, 51, 52, 53, etc.; 100, 101, 102, 103, etc.; 150, 151, 152, 153, etc.; including all integers through 200–500; 500–1,000, and the like.

The polynucleotides of the present invention, or fragments thereof, regardless of the length of the coding sequence itself, may be combined with other DNA sequences, such as promoters, polyadenylation signals, additional restriction enzyme sites, multiple cloning sites, other coding segments, and the like, such that their overall length may vary considerably. It is therefore contemplated that a nucleic acid fragment of almost any length may be employed, with the total length preferably being limited by the ease of preparation and use in the intended recombinant DNA protocol. For example, illustrative DNA segments with total lengths of about 10,000, about 5000, about 3000, about 2,000, about 1,000, about 500, about 200, about 100, about 50 base pairs in length, and the like, (including all intermediate lengths) are contemplated to be useful in many implementations of this invention.

In other embodiments, the present invention is directed to polynucleotides that are capable of hybridizing under moderately stringent conditions to a polynucleotide sequence provided herein, or a fragment thereof, or a complementary sequence thereof. Hybridization techniques are well known in the art of molecular biology. For purposes of illustration, suitable moderately stringent conditions for testing the hybridization of a polynucleotide of this invention with other polynucleotides include prewashing in a solution of 5 X SSC, 0.5% SDS, 1.0 mM EDTA (pH 8.0); hybridizing at 50° C.–65° C., 5 X SSC, overnight; followed by washing twice at 65° C. for 20 minutes with each of 2X, 0.5X and 0.2X SSC containing 0.1% SDS.

Moreover, it will be appreciated by those of ordinary skill in the art that, as a result of the degeneracy of the genetic code, there are many nucleotide sequences that encode a polypeptide as described herein. Some of these polynucleotides bear minimal homology to the nucleotide sequence of any native gene. Nonetheless, polynucleotides that vary due to differences in codon usage are specifically contemplated by the present invention. Further, alleles of the genes comprising the polynucleotide sequences provided herein are within the scope of the present invention. Alleles are endogenous genes that are altered as a result of one or more mutations, such as deletions, additions and/or substitutions of nucleotides. The resulting mRNA and protein may, but need not, have an altered structure or function. Alleles may be identified using standard techniques (such as hybridization, amplification and/or database sequence comparison).

PROBES AND PRIMERS

In other embodiments of the present invention, the polynucleotide sequences provided herein can be advantageously used as probes or primers for nucleic acid hybridization. As such, it is contemplated that nucleic acid segments that comprise a sequence region of at least about 15 nucleotide long contiguous sequence that has the same sequence as, or is complementary to, a 15 nucleotide long contiguous sequence disclosed herein will find particular utility. Longer contiguous identical or complementary sequences, e.g., those of about 20, 30, 40, 50, 100, 200, 500, 1000 (including all intermediate lengths) and even up to full length sequences will also be of use in certain embodiments.

The ability of such nucleic acid probes to specifically hybridize to a sequence of interest will enable them to be of use in detecting the presence of complementary sequences in a given sample. However, other uses are also envisioned, such as the use of the sequence information for the preparation of mutant species primers, or primers for use in preparing other genetic constructions.

Polynucleotide molecules having sequence regions consisting of contiguous nucleotide stretches of 10–14, 15–20, 30, 50, or even of 100–200 nucleotides or so (including intermediate lengths as well), identical or complementary to a polynucleotide sequence disclosed herein, are particularly contemplated as hybridization probes for use in, e.g., Southern and Northern blotting. This would allow a gene product, or fragment thereof, to be analyzed, both in diverse cell types and also in various bacterial cells. The total size of fragment, as well as the size of the complementary stretch (es), will ultimately depend on the intended use or application of the particular nucleic acid segment. Smaller fragments will generally find use in hybridization embodiments, wherein the length of the contiguous complementary region may be varied, such as between about 15 and about 100 nucleotides, but larger contiguous complementarity stretches may be used, according to the length complementary sequences one wishes to detect.

The use of a hybridization probe of about 15–25 nucleotides in length allows the formation of a duplex molecule that is both stable and selective. Molecules having contiguous complementary sequences over stretches greater than 15 bases in length are generally preferred, though, in order to increase stability and selectivity of the hybrid, and thereby improve the quality and degree of specific hybrid molecules obtained. One will generally prefer to design nucleic acid molecules having gene-complementary stretches of 15 to 25 contiguous nucleotides, or even longer where desired.

Hybridization probes may be selected from any portion of any of the sequences disclosed herein. All that is required is to review a sequence set forth herein or to any continuous portion of the sequence, from about 15–25 nucleotides in length up to and including the full length sequence, that one wishes to utilize as a probe or primer. The choice of probe and primer sequences may be governed by various factors. For example, one may wish to employ primers from towards the termini of the total sequence.

Small polynucleotide segments or fragments may be readily prepared by, for example, directly synthesizing the fragment by chemical means, as is commonly practiced using an automated oligonucleotide synthesizer. Also, fragments may be obtained by application of nucleic acid reproduction technology, such as the PCR™ technology of U. S. Pat. No. 4,683,202 (incorporated herein by reference), by introducing selected sequences into recombinant vectors for recombinant production, and by other recombinant DNA techniques generally known to those of skill in the art of molecular biology.

The nucleotide sequences of the invention may be used for their ability to selectively form duplex molecules with complementary stretches of the entire gene or gene fragments of interest. Depending on the application envisioned, one will typically desire to employ varying conditions of hybridization to achieve varying degrees of selectivity of probe towards target sequence. For applications requiring high selectivity, one will typically desire to employ relatively stringent conditions to form the hybrids, e.g., one will select relatively low salt and/or high temperature conditions, such as provided by a salt concentration of from about 0.02 M to about 0.15 M salt at temperatures of from about 50° C. to about 70° C. Such selective conditions tolerate little, if any, mismatch between the probe and the template or target strand, and would be particularly suitable for isolating related sequences.

Of course, for some applications, for example, where one desires to prepare mutants employing a mutant primer strand hybridized to an underlying template, less stringent (reduced stringency) hybridization conditions will typically be needed in order to allow formation of the heteroduplex. In these circumstances, one may desire to employ salt conditions such as those of from about 0.15 M to about 0.9 M salt, at temperatures ranging from about 20° C. to about 55° C. Cross-hybridizing species can thereby be readily identified as positively hybridizing signals with respect to control hybridizations. In any case, it is generally appreciated that conditions can be rendered more stringent by the addition of increasing amounts of formamide, which serves to destabilize the hybrid duplex in the same manner as increased temperature. Thus, hybridization conditions can be readily manipulated, and thus will generally be a method of choice depending on the desired results.

POLYNUCLEOTIDE IDENTIFICATION AND CHARACTERIZATION

Polynucleotides may be identified, prepared and/or manipulated using any of a variety of well established techniques. For example, a polynucleotide may be identified, as described in more detail below, by screening a microarray of cDNAs for tumor-associated expression (i.e., expression that is at least two fold greater in a tumor than in normal tissue, as determined using a representative assay provided herein). Such screens may be performed, for example, using a Synteni microarray (Palo Alto, Calif.) according to the manufacturer's instructions (and essentially as described by Schena et al., *Proc. Natl. Acad. Sci. USA* 93:10614–10619, 1996 and Heller et al., *Proc. Natl. Acad. Sci. USA* 94:2150–2155, 1997). Alternatively, polynucleotides may be amplified from cDNA prepared from cells expressing the proteins described herein, such as lung tumor cells. Such polynucleotides may be amplified via polymerase chain reaction (PCR). For this approach, sequence-specific primers may be designed based on the sequences provided herein, and may be purchased or synthesized.

An amplified portion of a polynucleotide of the present invention may be used to isolate a full length gene from a suitable library (e.g., a lung tumor cDNA library) using well known techniques. Within such techniques, a library (cDNA or genomic) is screened using one or more polynucleotide probes or primers suitable for amplification. Preferably, a library is size-selected to include larger molecules. Random primed libraries may also be preferred for identifying 5' and upstream regions of genes. Genomic libraries are preferred for obtaining introns and extending 5' sequences.

For hybridization techniques, a partial sequence may be labeled (e.g., by nick-translation or end-labeling with $^{32}$P) using well known techniques. A bacterial or bacteriophage library is then generally screened by hybridizing filters containing denatured bacterial colonies (or lawns containing phage plaques) with the labeled probe (see Sambrook et al., *Molecular Cloning: A Laboratory Manual*, Cold Spring Harbor Laboratories, Cold Spring Harbor, N.Y., 1989). Hybridizing colonies or plaques are selected and expanded, and the DNA is isolated for further analysis. cDNA clones may be analyzed to determine the amount of additional sequence by, for example, PCR using a primer from the partial sequence and a primer from the vector. Restriction maps and partial sequences may be generated to identify one or more overlapping clones. The complete sequence may then be determined using standard techniques, which may involve generating a series of deletion clones. The resulting overlapping sequences can then assembled into a single contiguous sequence. A full length cDNA molecule can be generated by ligating suitable fragments, using well known techniques.

Alternatively, there are numerous amplification techniques for obtaining a full length coding sequence from a partial cDNA sequence. Within such techniques, amplification is generally performed via PCR. Any of a variety of commercially available kits may be used to perform the amplification step. Primers may be designed using, for example, software well known in the art. Primers are preferably 22–30 nucleotides in length, have a GC content of at least 50% and anneal to the target sequence at temperatures of about 68° C. to 72° C. The amplified region may be sequenced as described above, and overlapping sequences assembled into a contiguous sequence.

One such amplification technique is inverse PCR (see Triglia et al., *Nucl. Acids Res.* 16:8186, 1988), which uses restriction enzymes to generate a fragment in the known region of the gene. The fragment is then circularized by intramolecular ligation and used as a template for PCR with divergent primers derived from the known region. Within an alternative approach, sequences adjacent to a partial sequence may be retrieved by amplification with a primer to a linker sequence and a primer specific to a known region. The amplified sequences are typically subjected to a second round of amplification with the same linker primer and a second primer specific to the known region. A variation on this procedure, which employs two primers that initiate extension in opposite directions from the known sequence, is described in WO 96/38591. Another such technique is known as "rapid amplification of cDNA ends" or RACE. This technique involves the use of an internal primer and an external primer, which hybridizes to a polyA region or vector sequence, to identify sequences that are 5' and 3' of a known sequence. Additional techniques include capture PCR (Lagerstrom et al., *PCR Methods Applic.* 1:111–19, 1991) and walking PCR (Parker et al., *Nucl. Acids. Res.* 19:3055–60, 1991). Other methods employing amplification may also be employed to obtain a full length cDNA sequence.

In certain instances, it is possible to obtain a full length cDNA sequence by analysis of sequences provided in an expressed sequence tag (EST) database, such as that available from GenBank. Searches for overlapping ESTs may generally be performed using well known programs (e.g., NCBI BLAST searches), and such ESTs may be used to generate a contiguous full length sequence. Full length DNA sequences may also be obtained by analysis of genomic fragments.

POLYNUCLEOTIDE EXPRESSION IN HOST CELLS

In other embodiments of the invention, polynucleotide sequences or fragments thereof which encode polypeptides of the invention, or fusion proteins or functional equivalents thereof, may be used in recombinant DNA molecules to direct expression of a polypeptide in appropriate host cells. Due to the inherent degeneracy of the genetic code, other DNA sequences that encode substantially the same or a functionally equivalent amino acid sequence may be produced and these sequences may be used to clone and express a given polypeptide.

As will be understood by those of skill in the art, it may be advantageous in some instances to produce polypeptide-encoding nucleotide sequences possessing non-naturally occurring codons. For example, codons preferred by a particular prokaryotic or eukaryotic host can be selected to increase the rate of protein expression or to produce a recombinant RNA transcript having desirable properties, such as a half-life which is longer than that of a transcript generated from the naturally occurring sequence.

Moreover, the polynucleotide sequences of the present invention can be engineered using methods generally known in the art in order to alter polypeptide encoding sequences for a variety of reasons, including but not limited to, alterations which modify the cloning, processing, and/or expression of the gene product. For example, DNA shuffling by random fragmentation and PCR reassembly of gene fragments and synthetic oligonucleotides may be used to engineer the nucleotide sequences. In addition, site-directed mutagenesis may be used to insert new restriction sites, alter glycosylation patterns, change codon preference, produce splice variants, or introduce mutations, and so forth.

In another embodiment of the invention, natural, modified, or recombinant nucleic acid sequences may be ligated to a heterologous sequence to encode a fusion protein. For example, to screen peptide libraries for inhibitors of polypeptide activity, it may be useful to encode a chimeric protein that can be recognized by a commercially available antibody. A fusion protein may also be engineered to contain a cleavage site located between the polypeptide-encoding sequence and the heterologous protein sequence, so that the polypeptide may be cleaved and purified away from the heterologous moiety.

Sequences encoding a desired polypeptide may be synthesized, in whole or in part, using chemical methods well known in the art (see Caruthers, M. H. et al. (1980) *Nucl. Acids Res. Symp. Ser.* 215–223, Horn, T. et al. (1980) *Nucl. Acids Res. Symp. Ser.* 225–232). Alternatively, the protein itself may be produced using chemical methods to synthesize the amino acid sequence of a polypeptide, or a portion thereof. For example, peptide synthesis can be performed using various solid-phase techniques (Roberge, J. Y. et al. (1995) *Science* 269:202–204) and automated synthesis may be achieved, for example, using the ABI 431 A Peptide Synthesizer (Perkin Elmer, Palo Alto, Calif.).

A newly synthesized peptide may be substantially purified by preparative high performance liquid chromatography (e.g., Creighton, T. (1983) Proteins, Structures and Molecular Principles, WH Freeman and Co., New York, N.Y.) or other comparable techniques available in the art. The composition of the synthetic peptides may be confirmed by amino acid analysis or sequencing (e.g., the Edman degradation procedure). Additionally, the amino acid sequence of a polypeptide, or any part thereof, may be altered during direct synthesis and/or combined using chemical methods with sequences from other proteins, or any part thereof, to produce a variant polypeptide.

In order to express a desired polypeptide, the nucleotide sequences encoding the polypeptide, or functional equivalents, may be inserted into appropriate expression vector, i.e., a vector which contains the necessary elements for the transcription and translation of the inserted coding sequence. Methods which are well known to those skilled in the art may be used to construct expression vectors containing sequences encoding a polypeptide of interest and appropriate transcriptional and translational control elements. These methods include in vitro recombinant DNA techniques, synthetic techniques, and in vivo genetic recombination. Such techniques are described in Sambrook, J. et al. (1989) Molecular Cloning, A Laboratory Manual, Cold Spring Harbor Press, Plainview, N.Y., and Ausubel, F. M. et al. (1989) Current Protocols in Molecular Biology, John Wiley & Sons, New York. N.Y.

A variety of expression vector/host systems may be utilized to contain and express polynucleotide sequences. These include, but are not limited to, microorganisms such as bacteria transformed with recombinant bacteriophage, plasmid, or cosmid DNA expression vectors; yeast transformed with yeast expression vectors; insect cell systems infected with virus expression vectors (e.g., baculovirus); plant cell systems transformed with virus expression vectors (e.g., cauliflower mosaic virus, CaMV; tobacco mosaic virus, TMV) or with bacterial expression vectors (e.g., Ti or pBR322 plasmids); or animal cell systems.

The "control elements" or "regulatory sequences" present in an expression vector are those non-translated regions of the vector—enhancers, promoters, 5' and 3' untranslated regions—which interact with host cellular proteins to carry out transcription and translation. Such elements may vary in their strength and specificity. Depending on the vector system and host utilized, any number of suitable transcription and translation elements, including constitutive and inducible promoters, may be used. For example, when cloning in bacterial systems, inducible promoters such as the hybrid lacZ promoter of the PBLUESCRIPT phagemid (Stratagene, La Jolla, Calif.) or PSPORT1 plasmid (Gibco BRL, Gaithersburg, Md.) and the like may be used. In mammalian cell systems, promoters from mammalian genes or from mammalian viruses are generally preferred. If it is necessary to generate a cell line that contains multiple copies of the sequence encoding a polypeptide, vectors based on SV40 or EBV may be advantageously used with an appropriate selectable marker.

In bacterial systems, a number of expression vectors may be selected depending upon the use intended for the expressed polypeptide. For example, when large quantities are needed, for example for the induction of antibodies, vectors which direct high level expression of fusion proteins that are readily purified may be used. Such vectors include, but are not limited to, the multifunctional E. coli cloning and expression vectors such as BLUESCRIPT (Stratagene), in which the sequence encoding the polypeptide of interest may be ligated into the vector in frame with sequences for the amino-terminal Met and the subsequent 7 residues of .beta.-galactosidase so that a hybrid protein is produced; pIN vectors (Van Heeke, G. and S. M. Schuster (1989) *J. Biol. Chem.* 264:5503–5509); and the like. pGEX Vectors (Promega, Madison, Wis.) may also be used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems may be designed to include heparin, thrombin, or factor XA protease cleavage sites so that the cloned polypeptide of interest can be released from the GST moiety at will.

In the yeast, Saccharomyces cerevisiae, a number of vectors containing constitutive or inducible promoters such as alpha factor, alcohol oxidase, and PGH may be used. For reviews, see Ausubel et al. (supra) and Grant et al. (1987) *Methods Enzymol.* 153:516–544.

In cases where plant expression vectors are used, the expression of sequences encoding polypeptides may be driven by any of a number of promoters. For example, viral promoters such as the 35S and 19S promoters of CaMV may be used alone or in combination with the omega leader sequence from TMV (Takamatsu, N. (1987) *EMBO J.* 6:307–311. Alternatively, plant promoters such as the small subunit of RUBISCO or heat shock promoters may be used (Coruzzi, G. et al. (1984) *EMBO J* 3:1671–1680; Broglie, R. et al. (1984) *Science* 224:838–843; and Winter, J. et al. (1991) *Results Probl. Cell Differ.* 17:85–105). These constructs can be introduced into plant cells by direct DNA transformation or pathogen-mediated transfection. Such techniques are described in a number of generally available reviews (see, for example, Hobbs, S. or Murry, L. E. in McGraw Hill Yearbook of Science and Technology (1992) McGraw Hill, New York, N.Y.; pp. 191–196).

An insect system may also be used to express a polypeptide of interest. For example, in one such system, Autographa californica nuclear polyhedrosis virus (AcNPV) is used as a vector to express foreign genes in Spodoptera frugiperda cells or in Trichoplusia larvae. The sequences encoding the polypeptide may be cloned into a non-essential region of the virus, such as the polyhedrin gene, and placed under control of the polyhedrin promoter. Successful insertion of the polypeptide-encoding sequence will render the polyhedrin gene inactive and produce recombinant virus lacking coat protein. The recombinant viruses may then be used to infect, for example, S. frugiperda cells or Trichoplusia larvae in which the polypeptide of interest may be expressed (Engelhard, E. K. et al. (1994) *Proc. Natl. Acad. Sci.* 91:3224–3227).

In mammalian host cells, a number of viral-based expression systems are generally available. For example, in cases where an adenovirus is used as an expression vector, sequences encoding a polypeptide of interest may be ligated into an adenovirus transcription/translation complex consisting of the late promoter and tripartite leader sequence. Insertion in a non-essential E1 or E3 region of the viral genome may be used to obtain a viable virus which is capable of expressing the polypeptide in infected host cells (Logan, J. and Shenk, T. (1984) *Proc. Natl. Acad. Sci.* 81:3655–3659). In addition, transcription enhancers, such as the Rous sarcoma virus (RSV) enhancer, may be used to increase expression in mammalian host cells.

Specific initiation signals may also be used to achieve more efficient translation of sequences encoding a polypeptide of interest. Such signals include the ATG initiation codon and adjacent sequences. In cases where sequences encoding the polypeptide, its initiation codon, and upstream sequences are inserted into the appropriate expression vector, no additional transcriptional or translational control signals may be needed. However, in cases where only coding sequence, or a portion thereof, is inserted, exogenous translational control signals including the ATG initiation codon should be provided. Furthermore, the initiation codon should be in the correct reading frame to ensure translation of the entire insert. Exogenous translational elements and initiation codons may be of various origins, both natural and synthetic. The efficiency of expression may be enhanced by the inclusion of enhancers which are appropriate for the particular cell system which is used, such as those described in the literature (Scharf, D. et al. (1994) *Results Probl. Cell Differ.* 20:125–162).

In addition, a host cell strain may be chosen for its ability to modulate the expression of the inserted sequences or to process the expressed protein in the desired fashion. Such modifications of the polypeptide include, but are not limited to, acetylation, carboxylation. glycosylation, phosphorylation, lipidation, and acylation. Post-translational processing which cleaves a "prepro" form of the protein may also be used to facilitate correct insertion, folding and/or function. Different host cells such as CHO, HeLa, MDCK, HEK293, and WI38, which have specific cellular machinery and characteristic mechanisms for such post-translational activities, may be chosen to ensure the correct modification and processing of the foreign protein.

For long-term, high-yield production of recombinant proteins, stable expression is generally preferred. For example, cell lines which stably express a polynucleotide of interest may be transformed using expression vectors which may contain viral origins of replication and/or endogenous expression elements and a selectable marker gene on the same or on a separate vector. Following the introduction of the vector, cells may be allowed to grow for 1–2 days in an enriched media before they are switched to selective media. The purpose of the selectable marker is to confer resistance to selection, and its presence allows growth and recovery of cells which successfully express the introduced sequences. Resistant clones of stably transformed cells may be proliferated using tissue culture techniques appropriate to the cell type.

Any number of selection systems may be used to recover transformed cell lines. These include, but are not limited to, the herpes simplex virus thymidine kinase (Wigler, M. et al. (1977) *Cell* 11:223–32) and adenine phosphoribosyltransferase (Lowy, I. et al. (1990) *Cell* 22:817–23) genes which can be employed in tk.sup.- or aprt.sup.- cells, respectively. Also, antimetabolite, antibiotic or herbicide resistance can be used as the basis for selection; for example, dhfr which confers resistance to methotrexate (Wigler, M. et al. (1980) *Proc. Natl. Acad. Sci.* 77:3567–70); npt, which confers resistance to the aminoglycosides, neomycin and G-418 (Colbere-Garapin, F. et al (1981) *J. Mol. Biol.* 150:1–14); and als or pat, which confer resistance to chlorsulfuron and phosphinotricin acetyltransferase, respectively (Murry, supra). Additional selectable genes have been described, for example, trpB, which allows cells to utilize indole in place of tryptophan, or hisD, which allows cells to utilize histinol in place of histidine (Hartman, S. C. and R. C. Mulligan (1988) *Proc. Natl. Acad. Sci.* 85:8047–51). Recently, the use of visible markers has gained popularity with such markers as anthocyanins, beta-glucuronidase and its substrate GUS, and luciferase and its substrate luciferin, being widely used not only to identify transformants, but also to quantify the amount of transient or stable protein expression attributable to a specific vector system (Rhodes, C. A. et al. (1995) *Methods Mol. Biol.* 55:121–131).

Although the presence/absence of marker gene expression suggests that the gene of interest is also present, its presence and expression may need to be confirmed. For example, if the sequence encoding a polypeptide is inserted within a marker gene sequence, recombinant cells containing sequences can be identified by the absence of marker gene function. Alternatively, a marker gene can be placed in tandem with a polypeptide-encoding sequence under the control of a single promoter. Expression of the marker gene in response to induction or selection usually indicates expression of the tandem gene as well.

Alternatively, host cells which contain and express a desired polynucleotide sequence may be identified by a variety of procedures known to those of skill in the art. These procedures include, but are not limited to, DNA—DNA or DNA–RNA hybridizations and protein bioassay or immunoassay techniques which include membrane, solution, or chip based technologies for the detection and/or quantification of nucleic acid or protein.

A variety of protocols for detecting and measuring the expression of polynucleotide-encoded products, using either polyclonal or monoclonal antibodies specific for the product are known in the art. Examples include enzyme-linked immunosorbent assay (ELISA), radioimmunoassay (RIA), and fluorescence activated cell sorting (FACS). A two-site, monoclonal-based immunoassay utilizing monoclonal antibodies reactive to two non-interfering epitopes on a given polypeptide may be preferred for some applications, but a competitive binding assay may also be employed. These and other assays are described, among other places, in Hampton, R. et al. (1990; Serological Methods, a Laboratory Manual, APS Press, St Paul. Minn.) and Maddox, D. E. et al. (1983; *J. Exp. Med.* 158:1211–1216).

A wide variety of labels and conjugation techniques are known by those skilled in the art and may be used in various nucleic acid and amino acid assays. Means for producing labeled hybridization or PCR probes for detecting sequences related to polynucleotides include oligolabeling, nick translation, end-labeling or PCR amplification using a labeled nucleotide. Alternatively, the sequences, or any portions thereof may be cloned into a vector for the production of an mRNA probe. Such vectors are known in the art, are commercially available, and may be used to synthesize RNA probes in vitro by addition of an appropriate RNA polymerase such as T7, T3, or SP6 and labeled nucleotides. These procedures may be conducted using a variety of commercially available kits. Suitable reporter molecules or labels, which may be used include radionuclides, enzymes, fluorescent, chemiluminescent, or chromogenic agents as well as substrates, cofactors, inhibitors, magnetic particles, and the like.

Host cells transformed with a polynucleotide sequence of interest may be cultured under conditions suitable for the expression and recovery of the protein from cell culture. The protein produced by a recombinant cell may be secreted or contained intracellularly depending on the sequence and/or the vector used. As will be understood by those of skill in the art, expression vectors containing polynucleotides of the invention may be designed to contain signal sequences which direct secretion of the encoded polypeptide through a prokaryotic or eukaryotic cell membrane. Other recombinant constructions may be used to join sequences encoding a polypeptide of interest to nucleotide sequence encoding a polypeptide domain which will facilitate purification of soluble proteins. Such purification facilitating domains include, but are not limited to, metal chelating peptides such as histidine-tryptophan modules that allow purification on immobilized metals, protein A domains that allow purification on immobilized immunoglobulin, and the domain utilized in the FLAGS extension/affinity purification system (Immunex Corp., Seattle, Wash.). The inclusion of cleavable linker sequences such as those specific for Factor XA or enterokinase (Invitrogen. San Diego, Calif.) between the purification domain and the encoded polypeptide may be used to facilitate purification. One such expression vector provides for expression of a fusion protein containing a polypeptide of interest and a nucleic acid encoding 6 histidine residues preceding a thioredoxin or an enterokinase cleavage site. The histidine residues facilitate purification on IMIAC (immobilized metal ion affinity chromatography) as described in Porath, J. et al. (1992, *Prot. Exp. Purif.* 3:263–281) while the enterokinase cleavage site provides a means for purifying the desired polypeptide from the fusion protein. A discussion of vectors which contain fusion proteins is provided in Kroll, D. J. et al. (1993; *DNA Cell Biol.* 12:441–453).

In addition to recombinant production methods, polypeptides of the invention, and fragments thereof, may be produced by direct peptide synthesis using solid-phase techniques (Merrifield J. (1963) *J. Am. Chem. Soc.* 85:2149–2154). Protein synthesis may be performed using manual techniques or by automation. Automated synthesis may be achieved, for example, using Applied Biosystems 431 A Peptide Synthesizer (Perkin Elmer). Alternatively, various fragments may be chemically synthesized separately and combined using chemical methods to produce the full length molecule.

SITE-SPECIFIC MUTAGENESIS

Site-specific mutagenesis is a technique useful in the preparation of individual peptides, or biologically functional equivalent polypeptides, through specific mutagenesis of the underlying polynucleotides that encode them. The technique, well-known to those of skill in the art, further provides a ready ability to prepare and test sequence variants, for example, incorporating one or more of the foregoing considerations, by introducing one or more nucleotide sequence changes into the DNA. Site-specific mutagenesis allows the production of mutants through the use of specific oligonucleotide sequences which encode the DNA sequence of the desired mutation, as well as a sufficient number of adjacent nucleotides, to provide a primer sequence of sufficient size and sequence complexity to form a stable duplex on both sides of the deletion junction being traversed. Mutations may be employed in a selected polynucleotide sequence to improve, alter, decrease, modify, or otherwise change the properties of the polynucleotide itself, and/or alter the properties, activity, composition, stability, or primary sequence of the encoded polypeptide.

In certain embodiments of the present invention, the inventors contemplate the mutagenesis of the disclosed polynucleotide sequences to alter one or more properties of the encoded polypeptide, such as the antigenicity of a polypeptide vaccine. The techniques of site-specific mutagenesis are well-known in the art, and are widely used to create variants of both polypeptides and polynucleotides. For example, site-specific mutagenesis is often used to alter a specific portion of a DNA molecule. In such embodiments, a primer comprising typically about 14 to about 25 nucleotides or so in length is employed, with about 5 to about 10 residues on both sides of the junction of the sequence being altered.

As will be appreciated by those of skill in the art, site-specific mutagenesis techniques have often employed a phage vector that exists in both a single stranded and double stranded form. Typical vectors useful in site-directed mutagenesis include vectors such as the M13 phage. These phage are readily commercially-available and their use is generally well-known to those skilled in the art. Double-stranded plasmids are also routinely employed in site directed mutagenesis that eliminates the step of transferring the gene of interest from a plasmid to a phage.

In general, site-directed mutagenesis in accordance herewith is performed by first obtaining a single-stranded vector or melting apart of two strands of a double-stranded vector that includes within its sequence a DNA sequence that encodes the desired peptide. An oligonucleotide primer bearing the desired mutated sequence is prepared, generally synthetically. This primer is then annealed with the single-stranded vector, and subjected to DNA polymerizing enzymes such as E. coli polymerase I Klenow fragment, in order to complete the synthesis of the mutation-bearing strand. Thus, a heteroduplex is formed wherein one strand encodes the original non-mutated sequence and the second strand bears the desired mutation. This heteroduplex vector is then used to transform appropriate cells, such as E. coli cells, and clones are selected which include recombinant vectors bearing the mutated sequence arrangement.

The preparation of sequence variants of the selected peptide-encoding DNA segments using site-directed mutagenesis provides a means of producing potentially useful species and is not meant to be limiting as there are other ways in which sequence variants of peptides and the DNA sequences encoding them may be obtained. For example, recombinant vectors encoding the desired peptide sequence may be treated with mutagenic agents, such as hydroxylamine, to obtain sequence variants. Specific details regarding these methods and protocols are found in the teachings of Maloy et al., 1994; Segal, 1976; Prokop and Bajpai, 1991; Kuby, 1994; and Maniatis et al., 1982, each incorporated herein by reference, for that purpose.

As used herein, the term "oligonucleotide directed mutagenesis procedure" refers to template-dependent processes and vector-mediated propagation which result in an increase in the concentration of a specific nucleic acid molecule relative to its initial concentration, or in an increase in the concentration of a detectable signal, such as amplification. As used herein, the term "oligonucleotide directed mutagenesis procedure" is intended to refer to a process that involves the template-dependent extension of a primer molecule. The term template dependent process refers to nucleic acid synthesis of an RNA or a DNA molecule wherein the sequence of the newly synthesized strand of nucleic acid is dictated by the well-known rules of complementary base pairing (see, for example, Watson, 1987). Typically, vector mediated methodologies involve the introduction of the nucleic acid fragment into a DNA or RNA vector, the clonal amplification of the vector, and the recovery of the amplified nucleic acid fragment. Examples of such methodologies are provided by U. S. Pat. No. 4,237,224, specifically incorporated herein by reference in its entirety.

POLYNUCLEOTIDE AMPLIFICATION TECHNIQUES

A number of template dependent processes are available to amplify the target sequences of interest present in a sample. One of the best known amplification methods is the polymerase chain reaction (PCR™) which is described in detail in U.S. Pat. Nos. 4,683,195, 4,683,202 and 4,800,159, each of which is incorporated herein by reference in its entirety. Briefly, in PCR™, two primer sequences are prepared which are complementary to regions on opposite complementary strands of the target sequence. An excess of deoxynucleoside triphosphates is added to a reaction mixture along with a DNA polymerase (e.g., Taq polymerase). If the target sequence is present in a sample, the primers will bind to the target and the polymerase will cause the primers to be extended along the target sequence by adding on nucleotides. By raising and lowering the temperature of the reaction mixture, the extended primers will dissociate from the target to form reaction products, excess primers will bind to the target and to the reaction product and the process is repeated. Preferably reverse transcription and PCR™ amplification procedure may be performed in order to quantify the amount of mRNA amplified. Polymerase chain reaction methodologies are well known in the art.

Another method for amplification is the ligase chain reaction (referred to as LCR), disclosed in Eur. Pat. Appl. Publ. No. 320,308 (specifically incorporated herein by reference in its entirety). In LCR, two complementary probe pairs are prepared, and in the presence of the target sequence, each pair will bind to opposite complementary strands of the target such that they abut. In the presence of a ligase, the two probe pairs will link to form a single unit. By temperature cycling, as in PCR™, bound ligated units dissociate from the target and then serve as "target sequences" for ligation of excess probe pairs. U.S. Pat. No. 4,883,750, incorporated herein by reference in its entirety, describes an alternative method of amplification similar to LCR for binding probe pairs to a target sequence.

Qbeta Replicase, described in PCT Intl. Pat. Appl. Publ. No. PCT/US87/00880, incorporated herein by reference in its entirety, may also be used as still another amplification method in the present invention. In this method, a replicative sequence of RNA that has a region complementary to that of a target is added to a sample in the presence of an RNA polymerase. The polymerase will copy the replicative sequence that can then be detected.

An isothermal amplification method, in which restriction endonucleases and ligases are used to achieve the amplification of target molecules that contain nucleotide 5'-[α-thio] triphosphates in one strand of a restriction site (Walker et al., 1992, incorporated herein by reference in its entirety), may also be useful in the amplification of nucleic acids in the present invention.

Strand Displacement Amplification (SDA) is another method of carrying out isothermal amplification of nucleic acids which involves multiple rounds of strand displacement and synthesis, i.e. nick translation. A similar method, called Repair Chain Reaction (RCR) is another method of amplification which may be useful in the present invention and is involves annealing several probes throughout a region targeted for amplification, followed by a repair reaction in which only two of the four bases are present. The other two bases can be added as biotinylated derivatives for easy detection. A similar approach is used in SDA.

Sequences can also be detected using a cyclic probe reaction (CPR). In CPR, a probe having a 3' and 5' sequences of non-target DNA and an internal or "middle" sequence of the target protein specific RNA is hybridized to DNA which is present in a sample. Upon hybridization, the reaction is treated with RNaseH, and the products of the probe are identified as distinctive products by generating a signal that is released after digestion. The original template is annealed to another cycling probe and the reaction is repeated. Thus, CPR involves amplifying a signal generated by hybridization of a probe to a target gene specific expressed nucleic acid.

Still other amplification methods described in Great Britain Pat. Appl. No. 2 202 328, and in PCT Intl. Pat. Appl. Publ. No. PCT/US89/01025, each of which is incorporated herein by reference in its entirety, may be used in accordance with the present invention. In the former application, "modified" primers are used in a PCR-like, template and enzyme dependent synthesis. The primers may be modified by labeling with a capture moiety (e.g., biotin) and/or a detector moiety (e.g., enzyme). In the latter application, an excess of labeled probes is added to a sample. In the presence of the target sequence, the probe binds and is cleaved catalytically. After cleavage, the target sequence is released intact to be bound by excess probe. Cleavage of the labeled probe signals the presence of the target sequence.

Other nucleic acid amplification procedures include transcription-based amplification systems (TAS) (Kwoh et al., 1989; PCT Intl. Pat. Appl. Publ. No. WO 88/10315, incorporated herein by reference in its entirety), including nucleic acid sequence based amplification (NASBA) and 3SR. In NASBA, the nucleic acids can be prepared for amplification by standard phenol/chloroform extraction, heat denaturation of a sample, treatment with lysis buffer and minispin columns for isolation of DNA and RNA or guanidinium chloride extraction of RNA. These amplification techniques involve annealing a primer that has sequences specific to the target sequence. Following polymerization, DNA/RNA hybrids are digested with RNase H while double stranded DNA molecules are heat-denatured again. In either case the single stranded DNA is made fully double stranded by addition of second target-specific primer, followed by polymerization. The double stranded DNA molecules are then multiply transcribed by a polymerase such as T7 or SP6. In an isothermal cyclic reaction, the RNAs are reverse transcribed into DNA, and transcribed once again with a polymerase such as T7 or SP6. The resulting products, whether truncated or complete, indicate target-specific sequences.

Eur. Pat. Appl. Publ. No. 329,822, incorporated herein by reference in its entirety, disclose a nucleic acid amplification process involving cyclically synthesizing single-stranded RNA ("ssRNA"), ssDNA, and double-stranded DNA (dsDNA), which may be used in accordance with the present invention. The ssRNA is a first template for a first primer oligonucleotide, which is elongated by reverse transcriptase (RNA-dependent DNA polymerase). The RNA is then removed from resulting DNA:RNA duplex by the action of ribonuclease H (RNase H, an RNase specific for RNA in a duplex with either DNA or RNA). The resultant ssDNA is a second template for a second primer, which also includes the sequences of an RNA polymerase promoter (exemplified by T7 RNA polymerase) 5' to its homology to its template. This primer is then extended by DNA polymerase (exemplified by the large "Klenow" fragment of E. Coli DNA polymerase I), resulting as a double-stranded DNA ("dsDNA") molecule, having a sequence identical to that of the original RNA between the primers and having additionally, at one end, a promoter sequence. This promoter sequence can be used by the appropriate RNA polymerase to make many RNA copies of the DNA. These copies can then re-enter the cycle leading to very swift amplification. With proper choice of enzymes, this amplification can be done isothermally without addition of enzymes at each cycle. Because of the cyclical nature of this process, the starting sequence can be chosen to be in the form of either DNA or RNA.

PCT Intl. Pat. Appl. Publ. No. WO 89/06700, incorporated herein by reference in its entirety, disclose a nucleic acid sequence amplification scheme based on the hybridization of a promoter/primer sequence to a target single-stranded DNA ("ssDNA") followed by transcription of many RNA copies of the sequence. This scheme is not cyclic; i.e. new templates are not produced from the resultant RNA transcripts. Other amplification methods include "RACE" (Frohman, 1990), and "one-sided PCR" (Ohara, 1989) which are well-known to those of skill in the art.

Methods based on ligation of two (or more) oligonucleotides in the presence of nucleic acid having the sequence of the resulting "di-oligonucleotide", thereby amplifying the di-oligonucleotide (Wu and Dean, 1996, incorporated herein by reference in its entirety), may also be used in the amplification of DNA sequences of the present invention.

BIOLOGICAL FUNCTIONAL EQUIVALENTS

Modification and changes may be made in the structure of the polynucleotides and polypeptides of the present invention and still obtain a functional molecule that encodes a polypeptide with desirable characteristics. As mentioned above, it is often desirable to introduce one or more mutations into a specific polynucleotide sequence. In certain circumstances, the resulting encoded polypeptide sequence is altered by this mutation, or in other cases, the sequence of the polypeptide is unchanged by one or more mutations in the encoding polynucleotide.

When it is desirable to alter the amino acid sequence of a polypeptide to create an equivalent, or even an improved, second-generation molecule, the amino acid changes may be achieved by changing one or more of the codons of the encoding DNA sequence, according to Table 1.

For example, certain amino acids may be substituted for other amino acids in a protein structure without appreciable loss of interactive binding capacity with structures such as, for example, antigen-binding regions of antibodies or binding sites on substrate molecules. Since it is the interactive capacity and nature of a protein that defines that protein's biological functional activity, certain amino acid sequence substitutions can,. be made in a protein sequence, and, of course, its underlying DNA coding sequence, and nevertheless obtain a protein with like properties. It is thus contemplated by the inventors that various changes may be made in the peptide sequences of the disclosed compositions, or corresponding DNA sequences which encode said peptides without appreciable loss-of their biological utility or activity.

TABLE 1

| Amino Acids | | | Codons |
|---|---|---|---|
| Alanine | Ala | A | GCA GCC GCG GCU |
| Cysteine | Cys | C | UGC UGU |
| Aspartic acid | Asp | D | GAC GAU |
| Glutamic acid | Glu | E | GAA GAG |
| Phenylalanine | Phe | F | UUC UUU |
| Glycine | Gly | G | GGA GGC GGG GGU |
| Histidine | His | H | CAC CAU |
| Isoleucine | Ile | I | AUA AUC AUU |
| Lysine | Lys | K | AAA AAG |
| Leucine | Leu | L | UUA UUG CUA CUC CUG CUU |
| Methionine | Met | M | AUG |
| Asparagine | Asn | N | AAC AAU |
| Proline | Pro | P | CCA CCC CCG CCU |
| Glutamine | Gln | Q | CAA CAG |
| Arginine | Arg | R | AGA AGG CGA CGC CGG CGU |
| Serine | Ser | S | AGC AGU UCA UCC UCG UCU |
| Threonine | Thr | T | ACA ACC ACG ACU |
| Valine | Val | V | GUA GUC GUG GUU |
| Tryptophan | Trp | W | UGG |
| Tyrosine | Tyr | Y | UAC UAU |

In making such changes, the hydropathic index of amino acids may be considered. The importance of the hydropathic amino acid index in conferring interactive biologic function on a protein is generally understood in the art (Kyte and Doolittle, 1982, incorporated herein by reference). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like. Each amino acid has been assigned a hydropathic index on the basis of its hydrophobicity and charge characteristics (Kyte and Doolittle, 1982). These values are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

It is known in the art that certain amino acids may be substituted by other amino acids having a similar hydropathic index or score and still result in a protein with similar biological activity, i.e. still obtain a biological functionally equivalent protein. In making such changes, the substitution of amino acids whose hydropathic indices are within ±2 is preferred, those within +1 are particularly preferred, and those within ±0.5 are even more particularly preferred. It is also understood in the art that the substitution of like amino acids can be made effectively on the basis of hydrophilicity. U.S. Pat. No. 4,554,101 (specifically incorporated herein by reference in its entirety), states that the greatest local average hydrophilicity of a protein, as governed by the hydrophilicity of its adjacent amino acids, correlates with a biological property of the protein.

As detailed in U.S. Pat. No. 4,554,101, the following hydrophilicity values have been assigned to amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4). It is understood that an amino acid can be substituted for another having a similar hydrophilicity value and still obtain a biologically equivalent, and in particular, an immunologically equivalent protein. In such changes, the substitution of amino acids whose hydrophilicity values are within ±2 is preferred, those within +1 are particularly preferred, and those within ±0.5 are even more particularly preferred.

As outlined above, amino acid substitutions are generally therefore based on the relative similarity of the amino acid side-chain substituents, for example, their hydrophobicity, hydrophilicity, charge, size, and the like. Exemplary substitutions that take various of the foregoing characteristics into consideration are well known to those of skill in the art and include: arginine and lysine; glutamate and aspartate; serine and threonine; glutamine and asparagine; and valine, leucine and isoleucine.

In addition, any polynucleotide may be further modified to increase stability in vivo. Possible modifications include, but are not limited to, the addition of flanking sequences at the 5' and/or 3' ends; the use of phosphorothioate or 2' O-methyl rather than phosphodiesterase linkages in the backbone; and/or the inclusion of nontraditional bases such as inosine, queosine and wybutosine, as well as acetyl-methyl-, thio- and other modified forms of adenine, cytidine, guanine, thymine and uridine.

IN VIVO POLYNUCLEOTIDE DELIVERY TECHNIQUES

In additional embodiments, genetic constructs comprising one or more of the polynucleotides of the invention are introduced into cells in vivo. This may be achieved using any of a variety or well known approaches, several of which are outlined below for the purpose of illustration.

1. ADENOVIRUS

One of the preferred methods for in vivo delivery of one or more nucleic acid sequences involves the use of an adenovirus expression vector. "Adenovirus expression vector" is meant to include those constructs containing adenovirus sequences sufficient to (a) support packaging of the construct and (b) to express a polynucleotide that has been cloned therein in a sense or antisense orientation. Of course, in the context of an antisense construct, expression does not require that the gene product be synthesized.

The expression vector comprises a genetically engineered form of an adenovirus. Knowledge of the genetic organization of adenovirus, a 36 kb, linear, double-stranded DNA virus, allows substitution of large pieces of adenoviral DNA with foreign sequences up to 7 kb (Grunhaus and Horwitz, 1992). In contrast to retrovirus, the adenoviral infection of host cells does not result in chromosomal integration because adenoviral DNA can replicate in an episomal manner without potential genotoxicity. Also, adenoviruses are structurally stable, and no genome rearrangement has been detected after extensive amplification. Adenovirus can infect virtually all epithelial cells regardless of their cell cycle stage. So far, adenoviral infection appears to be linked only to mild disease such as acute respiratory disease in humans.

Adenovirus is particularly suitable for use as a gene transfer vector because of its mid-sized genome, ease of manipulation, high titer, wide target-cell range and high infectivity. Both ends of the viral genome contain 100–200 base pair inverted repeats (ITRs), which are cis elements necessary for viral DNA replication and packaging. The early (E) and late (L) regions of the genome contain different transcription units that are divided by the onset of viral DNA replication. The E1 region (E1A and E1B) encodes proteins responsible for the regulation of transcription of the viral genome and a few cellular genes. The expression of the E2 region (E2A and E2B) results in the synthesis of the proteins for viral DNA replication. These proteins are involved in DNA replication, late gene expression and host cell shut-off (Renan, 1990). The products of the late genes, including the majority of the viral capsid proteins, are expressed only after significant processing of a single primary transcript issued by the major late promoter (MLP). The MLP, (located at 16.8 m.u.) is particularly efficient during the late phase of infection, and all the mRNA's issued from this promoter possess a 5'-tripartite leader (TPL) sequence which makes them preferred mRNA's for translation.

In a current system, recombinant adenovirus is generated from homologous recombination between shuttle vector and provirus vector. Due to the possible recombination between two proviral vectors, wild-type adenovirus may be generated from this process. Therefore, it is critical to isolate a single clone of virus from an individual plaque and examine its genomic structure.

Generation and propagation of the current adenovirus vectors, which are replication deficient, depend on a unique helper cell line, designated 293, which was ransformed from human embryonic kidney cells by Ad5 DNA fragments and constitutively expresses E1 proteins (Graham et al., 1977). Since the E3 region is dispensable from the adenovirus genome (Jones and Shenk, 1978), the current adenovirus vectors, with the help of 293 cells, carry foreign DNA in either the E1, the D3 or both regions (Graham and Prevec, 1991). In nature, adenovirus can package approximately 105% of the wild-type genome (Ghosh-Choudhury et al., 1987), providing capacity for about 2 extra kB of DNA. Combined with the approximately 5.5 kB of DNA that is replaceable in the E1 and E3 regions, the maximum capacity of the current adenovirus vector is under 7.5 kB, or about 15% of the total length of the vector. More than 80% of the adenovirus viral genome remains in the vector backbone and is the source of vector-borne cytotoxicity. Also, the replication deficiency of the E1-deleted virus is incomplete. For example, leakage of viral gene expression has been observed with the currently available vectors at high multiplicities of infection (MOI) (Mulligan, 1993).

Helper cell lines may be derived from human cells such as human embryonic kidney cells, muscle cells, hematopoietic cells or other human embryonic mesenchymal or epithelial cells. Alternatively, the helper cells may be derived from the cells of other mammalian species that are permissive for human adenovirus. Such cells include, e.g., Vero cells or other monkey embryonic mesenchymal or epithelial cells. As stated above, the currently preferred helper cell line is 293.

Recently, Racher et al. (1995) disclosed improved methods for culturing 293 cells and propagating adenovirus. In one format, natural cell aggregates are grown by inoculating individual cells into 1 liter siliconized spinner flasks (Techne, Cambridge, UK) containing 100–200 ml of medium. Following stirring at 40 rpm, the cell viability is estimated with trypan blue. In another format, Fibra-Cel microcarriers (Bibby Sterlin, Stone, UK) (5 g/l) is employed as follows. A cell inoculum, resuspended in 5 ml of medium, is added to the carrier (50 ml) in a 250 ml Erlenmeyer flask and left stationary, with occasional agitation, for 1 to 4 h. The medium is then replaced with 50 ml of fresh medium and shaking initiated. For virus production, cells are allowed to grow to about 80% confluence, after which time the medium is replaced (to 25% of the final volume) and adenovirus added at an MOI of 0.05. Cultures are left stationary overnight, following which the volume is increased to 100% and shaking commenced for another 72 h.

Other than the requirement that the adenovirus vector be replication defective, or at least conditionally defective, the nature of the adenovirus vector is not believed to be crucial to the successful practice of the invention. The adenovirus may be of any of the 42 different known serotypes or subgroups A–F. Adenovirus type 5 of subgroup C is the preferred starting material in order to obtain a conditional replication-defective adenovirus vector for use in the present invention, since Adenovirus type 5 is a human adenovirus about which a great deal of biochemical and genetic information is known, and it has historically been used for most constructions employing adenovirus as a vector.

As stated above, the typical vector according to the present invention is replication defective and will not have an adenovirus E1 region. Thus, it will be most convenient to introduce the polynucleotide encoding the gene of interest at the position from which the E1-coding sequences have been removed. However, the position of insertion of the construct within the adenovirus sequences is not critical to the invention. The polynucleotide encoding the gene of interest may also be inserted in lieu of the deleted E3 region in E3 replacement vectors as described by Karlsson et al. (1986) or in the E4 region where a helper cell line or helper virus complements the E4 defect.

Adenovirus is easy to grow and manipulate and exhibits broad host range in vitro and in vivo. This group of viruses can be obtained in high titers, e.g., $10^9$–$10^{11}$ plaque-forming units per ml, and they are highly infective. The life cycle of adenovirus does not require integration into the host cell genome. The foreign genes delivered by adenovirus vectors are episomal and, therefore, have low genotoxicity to host cells. No side effects have been reported in studies of vaccination with wild-type adenovirus (Couch et al., 1963; Top et al., 1971), demonstrating their safety and therapeutic potential as in vivo gene transfer vectors.

Adenovirus vectors have been used in eukaryotic gene expression (Levrero et al., 1991; Gomez-Foix et al., 1992) and vaccine development (Grunhaus and Horwitz, 1992; Graham and Prevec, 1992). Recently, animal studies suggested that recombinant adenovirus could be used for gene therapy (Stratford-Perricaudet and Perricaudet, 1991; Stratford-Perricaudet et al., 1990; Rich et al., 1993). Studies in administering recombinant adenovirus to different tissues include trachea instillation (Rosenfeld et al., 1991; Rosenfeld et al., 1992), muscle injection (Ragot et al., 1993), peripheral intravenous injections (Herz and Gerard, 1993) and stereotactic inoculation into the brain (Le Gal La Salle et al., 1993).

2. RETROVIRUSES

The retroviruses are a group of single-stranded RNA viruses characterized by an ability to convert their RNA to double-stranded DNA in infected cells by a process of reverse-transcription (Coffin, 1990). The resulting DNA then stably integrates into cellular chromosomes as a provirus and directs synthesis of viral proteins. The integration results in the retention of the viral gene sequences in the recipient cell and its descendants. The retroviral genome contains three genes, gag, pol, and env that code for capsid proteins, polymerase enzyme, and envelope components, respectively. A sequence found upstream from the gag gene contains a signal for packaging of the genome into virions. Two long terminal repeat (LTR) sequences are present at the 5' and 3' ends of the viral genome. These contain strong promoter and enhancer sequences and are also required for integration in the host cell genome (Coffin, 1990).

In order to construct a retroviral vector, a nucleic acid encoding one or more oligonucleotide or polynucleotide sequences of interest is inserted into the viral genome in the place of certain viral sequences to produce a virus that is replication-defective. In order to produce virions, a packaging cell line containing the gag, pol, and env genes but without the LTR and packaging components is constructed (Mann et al., 1983). When a recombinant plasmid containing a cDNA, together with the retroviral LTR and packaging sequences is introduced into this cell line (by calcium phosphate precipitation for example), the packaging sequence allows the RNA transcript of the recombinant plasmid to be packaged into viral particles, which are then secreted into the culture media (Nicolas and Rubenstein, 1988; Temin, 1986; Mann et al., 1983). The media containing the recombinant retroviruses is then collected, optionally concentrated, and used for gene transfer. Retroviral vectors are able to infect a broad variety of cell types. However, integration and stable expression require the division of host cells (Paskind et al., 1975).

A novel approach designed to allow specific targeting of retrovirus vectors was recently developed based on the chemical modification of a retrovirus by the chemical addition of lactose residues to the viral envelope. This modification could permit the specific infection of hepatocytes via sialoglycoprotein receptors.

A different approach to targeting of recombinant retroviruses was designed in which biotinylated antibodies against a retroviral envelope protein and against a specific cell receptor were used. The antibodies were coupled via the biotin components by using streptavidin (Roux et al., 1989). Using antibodies against major histocompatibility complex class I and class II antigens, they demonstrated the infection of a variety of human cells that bore those surface antigens with an ecotropic virus in vitro (Roux et al., 1989).

3. ADENO-ASSOCIATED VIRUSES

AAV (Ridgeway, 1988; Hermonat and Muzycska, 1984) is a parovirus, discovered as a contamination of adenoviral stocks. It is a ubiquitous virus (antibodies are present in 85% of the US human population) that has not been linked to any disease. It is also classified as a dependovirus, because its replications is dependent on the presence of a helper virus, such as adenovirus. Five serotypes have been isolated, of which AAV-2 is the best characterized. AAV has a single-stranded linear DNA that is encapsidated into capsid proteins VP1, VP2 and VP3 to form an icosahedral virion of 20 to 24 nm in diameter (Muzyczka and McLaughlin, 1988).

The AAV DNA is approximately 4.7 kilobases long. It contains two open reading frames and is flanked by two ITRs. There are two major genes in the AAV genome: rep and cap. The rep gene codes for proteins responsible for viral replications, whereas cap codes for capsid protein VP1-3. Each ITR forms a T-shaped hairpin structure. These terminal repeats are the only essential cis components of the AAV for chromosomal integration. Therefore, the AAV can be used as a vector with all viral coding sequences removed and replaced by the cassette of genes for delivery. Three viral promoters have been identified and named p5, p19, and p40, according to their map position. Transcription from p5 and p19 results in production of rep proteins, and transcription from p40 produces the capsid proteins (Hermonat and Muzyczka, 1984).

There are several factors that prompted researchers to study the possibility of using rAAV as an expression vector One is that the requirements for delivering a gene to integrate into the host chromosome are surprisingly few. It is necessary to have the 145-bp ITRs, which are only 6% of the AAV genome. This leaves room in the vector to assemble a 4.5-kb DNA insertion. While this carrying capacity may prevent the AAV from delivering large genes, it is amply suited for delivering the antisense constructs of the present invention.

AAV is also a good choice of delivery vehicles due to its safety. There is a relatively complicated rescue mechanism: not only wild type adenovirus but also AAV genes are required to mobilize rAAV. Likewise, AAV is not pathogenic and not associated with any disease. The removal of viral coding sequences minimizes immune reactions to viral gene expression, and therefore, rAAV does not evoke an inflammatory response.

4. OTHER VIRAL VECTORS AS EXPRESSION CONSTRUCTS

Other viral vectors may be employed as expression constructs in the present invention for the delivery of oligonucleotide or polynucleotide sequences to a host cell. Vectors derived from viruses such as vaccinia virus (Ridgeway, 1988; Coupar et al., 1988), lentiviruses, polio viruses and herpes viruses may be employed. They offer several attractive features for various mammalian cells (Friedmann, 1989; Ridgeway, 1988; Coupar et al., 1988; Horwich et al., 1990).

With the recent recognition of defective hepatitis B viruses, new insight was gained into the structure-function relationship of different viral sequences. In vitro studies showed that the virus could retain the ability for helper-dependent packaging and reverse transcription despite the deletion of up to 80% of its genome (Horwich et al., 1990). This suggested that large portions of the genome could be replaced with foreign genetic material. The hepatotropism and persistence (integration) were particularly attractive properties for liver-directed gene transfer. Chang et al.

(1991) introduced the chloramphenicol acetyltransferase (CAT) gene into duck hepatitis B virus genome in the place of the polymerase, surface, and pre-surface coding sequences. It was cotransfected with wild-type virus into an avian hepatoma cell line. Culture media containing high titers of the recombinant virus were used to infect primary duckling hepatocytes. Stable CAT gene expression was detected for at least 24 days after transfection (Chang et al., 1991).

5. NON-VIRAL VECTORS

In order to effect expression of the oligonucleotide or polynucleotide sequences of the present invention, the expression construct must be delivered into a cell. This delivery may be accomplished in vitro, as in laboratory procedures for transforming cells lines, or in vivo or ex vivo, as in the treatment of certain disease states. As described above, one preferred mechanism for delivery is via viral infection where the expression construct is encapsulated in an infectious viral particle.

Once the expression construct has been delivered into the cell the nucleic acid encoding the desired oligonucleotide or polynucleotide sequences may be positioned and expressed at different sites. In certain embodiments, the nucleic acid encoding the construct may be stably integrated into the genome of the cell. This integration may be in the specific location and orientation via homologous recombination (gene replacement) or it may be integrated in a random, non-specific location (gene augmentation). In yet further embodiments, the nucleic acid may be stably maintained in the cell as a separate, episomal segment of DNA. Such nucleic acid segments or "episomes" encode sequences sufficient to permit maintenance and replication independent of or in synchronization with the host cell cycle. How the expression construct is delivered to a cell and where in the cell the nucleic acid remains is dependent on the type of expression construct employed.

In certain embodiments of the invention, the expression construct comprising one or more oligonucleotide or polynucleotide sequences may simply consist of naked recombinant DNA or plasmids. Transfer of the construct may be performed by any of the methods mentioned above which physically or chemically permeabilize the cell membrane. This is particularly applicable for transfer in vitro but it may be applied to in vivo use as well. Dubensky et al. (1984) successfully injected polyomavirus DNA in the form of calcium phosphate precipitates into liver and spleen of adult and newborn mice demonstrating active viral replication and acute infection. Benvenisty and Reshef (1986) also demonstrated that direct intraperitoneal injection of calcium phosphate-precipitated plasmids results in expression of the transfected genes. It is envisioned that DNA encoding a gene of interest may also be transferred in a similar manner in vivo and express the gene product.

Another embodiment of the invention for transferring a naked DNA expression construct into cells may involve particle bombardment. This method depends on the ability to accelerate DNA-coated microprojectiles to a high velocity allowing them to pierce cell membranes and enter cells without killing them (Klein et al., 1987). Several devices for accelerating small particles have been developed. One such device relies on a high voltage discharge to generate an electrical current, which in turn provides the motive force (Yang et al., 1990). The microprojectiles used have consisted of biologically inert substances such as tungsten or gold beads.

Selected organs including the liver, skin, and muscle tissue of rats and mice have been bombarded in vivo (Yang et al., 1990; Zelenin et al., 1991). This may require surgical exposure of the tissue or cells, to eliminate any intervening tissue between the gun and the target organ, i.e. ex vivo treatment. Again, DNA encoding a particular gene may be delivered via this method and still be incorporated by the present invention.

ANTISENSE OLIGONUCLEOTIDES

The end result of the flow of genetic information is the synthesis of protein. DNA is transcribed by polymerases into messenger RNA and translated on the ribosome to yield a folded, functional protein. Thus there are several steps along the route where protein synthesis can be inhibited. The native DNA segment coding for a polypeptide described herein, as all such mammalian DNA strands, has two strands: a sense strand and an antisense strand held together by hydrogen bonding. The messenger RNA coding for polypeptide has the same nucleotide sequence as the sense DNA strand except that the DNA thymidine is replaced by uridine. Thus, synthetic antisense nucleotide sequences will bind to a mRNA and inhibit expression of the protein encoded by that mRNA.

The targeting of antisense oligonucleotides to mRNA is thus one mechanism to shut down protein synthesis, and, consequently, represents a powerful and targeted therapeutic approach. For example, the synthesis of polygalactauronase and the muscarine type 2 acetylcholine receptor are inhibited by antisense oligonucleotides directed to their respective mRNA sequences (U.S. Pat. No. 5,739,119 and U.S. Pat. No. 5,759,829, each specifically incorporated herein by reference in its entirety). Further, examples of antisense inhibition have been demonstrated with the nuclear protein cyclin, the multiple drug resistance gene (MDG1), ICAM-1, E-selectin, STK-1, striatal $GABA_A$ receptor and human EGF (Jaskulski et al., 1988; Vasanthakumar and Ahmed, 1989; Peris et al., 1998; U.S. Pat. No. 5,801,154; U.S. Pat. No. 5,789,573; U.S. Pat. No. 5,718,709 and U.S. Pat. No. 5,610,288, each specifically incorporated herein by reference in its entirety). Antisense constructs have also been described that inhibit and can be used to treat a variety of abnormal cellular proliferations, e.g. cancer (U.S. Pat. No. 5,747,470; U.S. Pat. No. 5,591,317 and U.S. Pat. No. 5,783,683, each specifically incorporated herein by reference in its entirety).

Therefore, in exemplary embodiments, the invention provides oligonucleotide sequences that comprise all, or a portion of, any sequence that is capable of specifically binding to polynucleotide sequence described herein, or a complement thereof. In one embodiment, the antisense oligonucleotides comprise DNA or derivatives thereof. In another embodiment, the oligonucleotides comprise RNA or derivatives thereof. In a third embodiment, the oligonucleotides are modified DNAs comprising a phosphorothioated modified backbone. In a fourth embodiment, the oligonucleotide sequences comprise peptide nucleic acids or derivatives thereof. In each case, preferred compositions comprise a sequence region that is complementary, and more preferably substantially-complementary, and even more preferably, completely complementary to one or more portions of polynucleotides disclosed herein.

Selection of antisense compositions specific for a given gene sequence is based upon analysis of the chosen target sequence (i.e. in these illustrative examples the rat and human sequences) and determination of secondary structure, $T_m$, binding energy, relative stability, and antisense compositions were selected based upon their relative inability to form dimers, hairpins, or other secondary structures that would reduce or prohibit specific binding to the target mRNA in a host cell.

Highly preferred target regions of the mRNA, are those which are at or near the AUG translation initiation codon, and those sequences which were substantially complementary to 5' regions of the mRNA. These secondary structure analyses and target site selection considerations were performed using v.4 of the OLIGO primer analysis software (Rychlik, 1997) and the BLASTN 2.0.5 algorithm software (Altschul et al., 1997).

The use of an antisense delivery method employing a short peptide vector, termed MPG (27 residues), is also contemplated. The MPG peptide contains a hydrophobic domain derived from the fusion sequence of HIV gp41 and a hydrophilic domain from the nuclear localization sequence of SV40 T-antigen (Morris et al., 1997). It has been demonstrated that several molecules of the MPG peptide coat the antisense oligonucleotides and can be delivered into cultured mammalian cells in less than 1 hour with relatively high efficiency (90%). Further, the interaction with MPG strongly increases both the stability of the oligonucleotide to nuclease and the ability to cross the plasma membrane (Morris et al., 1997).

RIBOZYMES

Although proteins traditionally have been used for catalysis of nucleic acids, another class of macromolecules has emerged as useful in this endeavor. Ribozymes are RNA-protein complexes that cleave nucleic acids in a site-specific fashion. Ribozymes have specific catalytic domains that possess endonuclease activity (Kim and Cech, 1987; Gerlach et al., 1987; Forster and Symons, 1987). For example, a large number of ribozymes accelerate phosphoester transfer reactions with a high degree of specificity, often cleaving only one of several phosphoesters in an oligonucleotide substrate (Cech et al., 1981; Michel and Westhof, 1990; Reinhold-Hurek and Shub, 1992). This specificity has been attributed to the requirement that the substrate bind via specific base-pairing interactions to the internal guide sequence ("IGS") of the ribozyme prior to chemical reaction.

Ribozyme catalysis has primarily been observed as part of sequence-specific cleavage/ligation reactions involving nucleic acids (Joyce, 1989; Cech et al., 1981). For example, U.S. Pat. No. 5,354,855 (specifically incorporated herein by reference) reports that certain ribozymes can act as endonucleases with a sequence specificity greater than that of known ribonucleases and approaching that of the DNA restriction enzymes. Thus, sequence-specific ribozyme-mediated inhibition of gene expression may be particularly suited to therapeutic applications (Scanlon et al., 1991; Sarver et al., 1990). Recently, it was reported that ribozymes elicited genetic changes in some cells lines to which they were applied; the altered genes included the oncogenes H-ras, c-fos and genes of HIV. Most of this work involved the modification of a target mRNA, based on a specific mutant codon that is cleaved by a specific ribozyme.

Six basic varieties of naturally-occurring enzymatic RNAs are known presently. Each can catalyze the hydrolysis of RNA phosphodiester bonds in trans (and thus can cleave other RNA molecules) under physiological conditions. In general, enzymatic nucleic acids act by first binding to a target RNA. Such binding occurs through the target binding portion of a enzymatic nucleic acid which is held in close proximity to an enzymatic portion of the molecule that acts to cleave the target RNA. Thus, the enzymatic nucleic acid first recognizes and then binds a target RNA through complementary base-pairing, and once bound to the correct site, acts enzymatically to cut the target RNA. Strategic cleavage of such a target RNA will destroy its ability to direct synthesis of an encoded protein. After an enzymatic nucleic acid has bound and cleaved its RNA target, it is released from that RNA to search for another target and can repeatedly bind and cleave new targets.

The enzymatic nature of a ribozyme is advantageous over many technologies, such as antisense technology (where a nucleic acid molecule simply binds to a nucleic acid target to block its translation) since the concentration of ribozyme necessary to affect a therapeutic treatment is lower than that of an antisense oligonucleotide. This advantage reflects the ability of the ribozyme to act enzymatically. Thus, a single ribozyme molecule is able to cleave many molecules of target RNA. In addition, the ribozyme is a highly specific inhibitor, with the specificity of inhibition depending not only on the base pairing mechanism of binding to the target RNA, but also on the mechanism of target RNA cleavage. Single mismatches, or base-substitutions, near the site of cleavage can completely eliminate catalytic activity of a ribozyme. Similar mismatches in antisense molecules do not prevent their action (Woolf et al., 1992). Thus, the specificity of action of a ribozyme is greater than that of an antisense oligonucleotide binding the same RNA site.

The enzymatic nucleic acid molecule may be formed in a hammerhead, hairpin, a hepatitis δ virus, group I intron or RNaseP RNA (in association with an RNA guide sequence) or Neurospora VS RNA motif. Examples of hammerhead motifs are described by Rossi et al. (1992). Examples of hairpin motifs are described by Hampel et al. (Eur. Pat. Appl. Publ. No. EP 0360257), Hampel and Tritz (1989), Hampel et al. (1990) and U.S. Pat. No. 5,631,359 (specifically incorporated herein by reference). An example of the hepatitis δ virus motif is described by Perrotta and Been (1992); an example of the RNaseP motif is described by Guerrier-Takada et al. (1983); Neurospora VS RNA ribozyme motif is described by Collins (Saville and Collins, 1990; Saville and Collins, 1991; Collins and Olive, 1993); and an example of the Group I intron is described in (U.S. Pat. No. 4,987,071, specifically incorporated herein by reference). All that is important in an enzymatic nucleic acid molecule of this invention is that it has a specific substrate binding site which is complementary to one or more of the target gene RNA regions, and that it have nucleotide sequences within or surrounding that substrate binding site which impart an RNA cleaving activity to the molecule. Thus the ribozyme constructs need not be limited to specific motifs mentioned herein.

In certain embodiments, it may be important to produce enzymatic cleaving agents which exhibit a high degree of specificity for the RNA of a desired target, such as one of the sequences disclosed herein. The enzymatic nucleic acid molecule is preferably targeted to a highly conserved sequence region of a target mRNA. Such enzymatic nucleic acid molecules can be delivered exogenously to specific cells as required. Alternatively, the ribozymes can be expressed from DNA or RNA vectors that are delivered to specific cells.

Small enzymatic nucleic acid motifs (e.g., of the hammerhead or the hairpin structure) may also be used for exogenous delivery. The simple structure of these molecules increases the ability of the enzymatic nucleic acid to invade targeted regions of the mRNA structure. Alternatively, catalytic RNA molecules can be expressed within cells from eukaryotic promoters (e.g., Scanlon et al., 1991; Kashani-Sabet et al., 1992; Dropulic et al., 1992; Weerasinghe et al., 1991; Ojwang et al., 1992; Chen et al., 1992; Sarver et al., 1990). Those skilled in the art realize that any ribozyme can be expressed in eukaryotic cells from the appropriate DNA vector. The activity of such ribozymes can be augmented by their release from the primary transcript by a second ribozyme (Int. Pat. Appl. Publ. No. WO 93/23569, and Int. Pat. Appl. Publ. No. WO 94/02595, both hereby incorporated by reference; Ohkawa et al., 1992; Taira et al., 1991; and Ventura et al., 1993).

Ribozymes may be added directly, or can be complexed with cationic lipids, lipid complexes, packaged within liposomes, or otherwise delivered to target cells. The RNA or RNA complexes can be locally administered to relevant tissues ex vivo, or in vivo through injection, aerosol inhalation, infusion pump or stent, with or without their incorporation in biopolymers.

Ribozymes may be designed as described in Int. Pat. Appl. Publ. No. WO 93/23569 and Int. Pat. Appl. Publ. No. WO 94/02595, each specifically incorporated herein by reference) and synthesized to be tested in vitro and in vivo, as described. Such ribozymes can also be optimized for delivery. While specific examples are provided, those in the art will recognize that equivalent RNA targets in other species can be utilized when necessary.

Hammerhead or hairpin ribozymes may be individually analyzed by computer folding (Jaeger et al., 1989) to assess whether the ribozyme sequences fold into the appropriate secondary structure. Those ribozymes with unfavorable intramolecular interactions between the binding arms and the catalytic core are eliminated from consideration. Varying binding arm lengths can be chosen to optimize activity. Generally, at least 5 or so bases on each arm are able to bind to, or otherwise interact with, the target RNA.

Ribozymes of the hammerhead or hairpin motif may be designed to anneal to various sites in the mRNA message, and can be chemically synthesized. The method of synthesis used follows the procedure for normal RNA synthesis as described in Usman et al. (1987) and in Scaringe et al. (1990) and makes use of common nucleic acid protecting and coupling groups, such as dimethoxytrityl at the 5'-end, and phosphoramidites at the 3'-end. Average stepwise coupling yields are typically >98%. Hairpin ribozymes may be synthesized in two parts and annealed to reconstruct an active ribozyme (Chowrira and Burke, 1992). Ribozymes may be modified extensively to enhance stability by modification with nuclease resistant groups, for example, 2'-amino, 2'-C-allyl, 2'-fluoro, 2'-O-methyl, 2'-H (for a review see e.g., Usman and Cedergren, 1992). Ribozymes may be purified by gel electrophoresis using general methods or by high pressure liquid chromatography and resuspended in water.

Ribozyme activity can be optimized by altering the length of the ribozyme binding arms, or chemically synthesizing ribozymes with modifications that prevent their degradation by serum ribonucleases (see e.g., Int. Pat. Appl. Publ. No. WO 92/07065; Perrault et al, 1990; Pieken et al., 1991; Usman and Cedergren, 1992; Int. Pat. Appl. Publ. No. WO 93/15187; Int. Pat. Appl. Publ. No. WO 91/03162; Eur. Pat. Appl. Publ. No. 92110298.4; U.S. Pat. No. 5,334,711; and Int. Pat. Appl. Publ. No. WO 94/13688, which describe various chemical modifications that can be made to the sugar moieties of enzymatic RNA molecules), modifications which enhance their efficacy in cells, and removal of stem II bases to shorten RNA synthesis times and reduce chemical requirements.

Sullivan et al. (Int. Pat. Appl. Publ. No. WO 94/02595) describes the general methods for delivery of enzymatic RNA molecules. Ribozymes may be administered to cells by a variety of methods known to those familiar to the art, including, but not restricted to, encapsulation in liposomes, by iontophoresis, or by incorporation into other vehicles, such as hydrogels, cyclodextrins, biodegradable nanocapsules, and bioadhesive microspheres. For some indications, ribozymes may be directly delivered ex vivo to cells or tissues with or without the aforementioned vehicles. Alternatively, the RNA/vehicle combination may be locally delivered by direct inhalation, by direct injection or by use of a catheter, infusion pump or stent. Other routes of delivery include, but are not limited to, intravascular, intramuscular, subcutaneous or joint injection, aerosol inhalation, oral (tablet or pill form), topical, systemic, ocular, intraperitoneal and/or intrathecal delivery. More detailed descriptions of ribozyme delivery and administration are provided in Int. Pat. Appl. Publ. No. WO 94/02595 and Int. Pat. Appl. Publ. No. WO 93/23569, each specifically incorporated herein by reference.

Another means of accumulating high concentrations of a ribozyme(s) within cells is to incorporate the ribozyme-encoding sequences into a DNA expression vector. Transcription of the ribozyme sequences are driven from a promoter for eukaryotic RNA polymerase I (pol I), RNA polymerase II (pol II), or RNA polymerase III (pol III). Transcripts from pol II or pol III promoters will be expressed at high levels in all cells; the levels of a given pol II promoter in a given cell type will depend on the nature of the gene regulatory sequences (enhancers, silencers, etc.) present nearby. Prokaryotic RNA polymerase promoters may also be used, providing that the prokaryotic RNA polymerase enzyme is expressed in the appropriate cells (Elroy-Stein and Moss, 1990; Gao and Huang, 1993; Lieber et al., 1993; Zhou et al., 1990). Ribozymes expressed from such promoters can function in mammalian cells (e.g. Kashani-Saber et al., 1992; Ojwang et al., 1992; Chen et al., 1992; Yu et al., 1993; L'Huillier et al., 1992; Lisziewicz et al., 1993). Such transcription units can be incorporated into a variety of vectors for introduction into mammalian cells, including but not restricted to, plasmid DNA vectors, viral DNA vectors (such as adenovirus or adeno-associated vectors), or viral RNA vectors (such as retroviral, semliki forest virus, sindbis virus vectors).

Ribozymes may be used as diagnostic tools to examine genetic drift and mutations within diseased cells. They can also be used to assess levels of the target RNA molecule. The close relationship between ribozyme activity and the structure of the target RNA allows the detection of mutations in any region of the molecule which alters the base-pairing and three-dimensional structure of the target RNA. By using multiple ribozymes, one may map nucleotide changes which are important to RNA structure and function in vitro, as well as in cells and tissues. Cleavage of target RNAs with ribozymes may be used to inhibit gene expression and define the role (essentially) of specified gene products in the progression of disease. In this manner, other genetic targets may be defined as important mediators of the disease. These studies will lead to better treatment of the disease progression by affording the possibility of combinational therapies (e.g., multiple ribozymes targeted to different genes, ribozymes coupled with known small molecule inhibitors, or intermittent treatment with combinations of ribozymes and/or other chemical or biological molecules). Other in vitro uses of ribozymes are well known in the art, and include detection of the presence of mRNA associated with an IL-5 related condition. Such RNA is detected by determining the presence of a cleavage product after treatment with a ribozyme using standard methodology.

PEPTIDE NUCLEIC ACIDS

In certain embodiments, the inventors contemplate the use of peptide nucleic acids (PNAs) in the practice of the methods of the invention. PNA is a DNA mimic in which the nucleobases are attached to a pseudopeptide backbone (Good and Nielsen, 1997). PNA is able to be utilized in a number methods that traditionally have used RNA or DNA. Often PNA sequences perform better in techniques than the corresponding RNA or DNA sequences and have utilities that are not inherent to RNA or DNA. A review of PNA including methods of making, characteristics of, and methods of using, is provided by Corey (1997) and is incorporated herein by reference. As such, in certain embodiments, one may prepare PNA sequences that are complementary to one or more portions of the ACE mRNA sequence, and such PNA compositions may be used to regulate, alter, decrease, or reduce the translation of ACE-specific mRNA, and thereby alter the level of ACE activity in a host cell to which such PNA compositions have been administered.

PNAs have 2-aminoethyl-glycine linkages replacing the normal phosphodiester backbone of DNA (Nielsen et al., 1991; Hanvey et al., 1992; Hyrup and Nielsen, 1996; Neilsen, 1996). This chemistry has three important consequences: firstly, in contrast to DNA or phosphorothioate oligonucleotides, PNAs are neutral molecules; secondly, PNAs are achiral, which avoids the need to develop a stereoselective synthesis; and thirdly, PNA synthesis uses standard Boc (Dueholm et al., 1994) or Fmoc (Thomson et al., 1995) protocols for solid-phase-peptide synthesis, although other methods, including a modified Merrifield method, have been used (Christensen et al., 1995).

PNA monomers or ready-made oligomers are commercially available from PerSeptive Biosystems (Framingham, Mass.). PNA syntheses by either Boc or Fmoc protocols are straightforward using manual or automated protocols (Norton et al., 1995). The manual protocol lends itself to the production of chemically modified PNAs or the simultaneous synthesis of families of closely related PNAs.

As with peptide synthesis, the success of a particular PNA synthesis will depend on the properties of the chosen sequence. For example, while in theory PNAs can incorporate any combination of nucleotide bases, the presence of adjacent purines can lead to deletions of one or more residues in the product. In expectation of this difficulty, it is suggested that, in producing PNAs with adjacent purines, one should repeat the coupling of residues likely to be added inefficiently. This should be followed by the purification of PNAs by reverse-phase high-pressure liquid chromatography (Norton et al., 1995) providing yields and purity of product similar to those observed during the synthesis of peptides.

Modifications of PNAs for a given application may be accomplished by coupling amino acids during solid-phase synthesis or by attaching compounds that contain a carboxylic acid group to the exposed N-terminal amine. Alternatively, PNAs can be modified after synthesis by coupling to an introduced lysine or cysteine. The ease with which PNAs can be modified facilitates optimization for better solubility or for specific functional requirements. Once synthesized, the identity of PNAs and their derivatives can be confirmed by mass spectrometry. Several studies have made and utilized modifications of PNAs (Norton et al., 1995; Haaima et al., 1996; Stetsenko et al., 1996; Petersen et al., 1995; Ulmann et al., 1996; Koch et al., 1995; Orum et al., 1995; Footer et al., 1996; Griffith et al., 1995; Kremsky et al., 1996; Pardridge et al., 1995; Boffa et al., 1995; Landsdorp et al., 1996; Gambacorti-Passerini et al., 1996; Armitage et al., 1997; Seeger et al., 1997; Ruskowski et al., 1997). U.S. Pat. No. 5,700,922 discusses PNA-DNA-PNA chimeric molecules and their uses in diagnostics, modulating protein in organisms, and treatment of conditions susceptible to therapeutics.

In contrast to DNA and RNA, which contain negatively charged linkages, the PNA backbone is neutral. In spite of this dramatic alteration, PNAs recognize complementary DNA and RNA by Watson-Crick pairing (Egholm et al., 1993), validating the initial modeling by Nielsen et al. (1991). PNAs lack 3' to 5' polarity and can bind in either parallel or antiparallel fashion, with the antiparallel mode being preferred (Egholm et al., 1993).

Hybridization of DNA oligonucleotides to DNA and RNA is destabilized by electrostatic repulsion between the negatively charged phosphate backbones of the complementary strands. By contrast, the absence of charge repulsion in PNA-DNA or PNA-RNA duplexes increases the melting temperature ($T_m$) and reduces the dependence of $T_m$ on the concentration of mono- or divalent cations (Nielsen et al., 1991). The enhanced rate and affinity of hybridization are significant because they are responsible for the surprising ability of PNAs to perform strand invasion of complementary sequences within relaxed double-stranded DNA. In addition, the efficient hybridization at inverted repeats suggests that PNAs can recognize secondary structure effectively within double-stranded DNA. Enhanced recognition also occurs with PNAs immobilized on surfaces, and Wang et al. have shown that support-bound PNAs can be used to detect hybridization events (Wang et al., 1996).

One might expect that tight binding of PNAs to complementary sequences would also increase binding to similar (but not identical) sequences, reducing the sequence specificity of PNA recognition. As with DNA hybridization, however, selective recognition can be achieved by balancing oligomer length and incubation temperature. Moreover, selective hybridization of PNAs is encouraged by PNA-DNA hybridization being less tolerant of base mismatches than DNA-DNA hybridization. For example, a single mismatch within a 16 bp PNA-DNA duplex can reduce the $T_m$ by up to 15° C. (Egholm et al., 1993). This high level of discrimination has allowed the development of several PNA-based strategies for the analysis of point mutations (Wang et al., 1996; Carlsson et al., 1996; Thiede et al., 1996; Webb and Hurskainen, 1996; Perry-O'Keefe et al., 1996).

High-affinity binding provides clear advantages for molecular recognition and the development of new applications for PNAs. For example, 11–13 nucleotide PNAs inhibit the activity of telomerase, a ribonucleo-protein that extends telomere ends using an essential RNA template, while the analogous DNA oligomers do not (Norton et al., 1996).

Neutral PNAs are more hydrophobic than analogous DNA oligomers, and this can lead to difficulty solubilizing them at neutral pH, especially if the PNAs have a high purine content or if they have the potential to form secondary structures. Their solubility can be enhanced by attaching one or more positive charges to the PNA termini (Nielsen et al., 1991).

Findings by Allfrey and colleagues suggest that strand invasion will occur spontaneously at sequences within chromosomal DNA (Boffa et al., 1995; Boffa et al., 1996). These studies targeted PNAs to triplet repeats of the nucleotides CAG and used this recognition to purify transcriptionally active DNA (Boffa et al., 1995) and to inhibit transcription (Boffa et al., 1996). This result suggests that if PNAs can be delivered within cells then they will have the potential to be general sequence-specific regulators of gene expression. Studies and reviews concerning the use of PNAs as antisense and anti-gene agents include Nielsen et al. (1993b), Hanvey et al. (1992), and Good and Nielsen (1997). Koppelhus et al. (1997) have used PNAs to inhibit HIV-1 inverse transcription, showing that PNAs may be used for antiviral therapies.

Methods of characterizing the antisense binding properties of PNAs are discussed in Rose (1993) and Jensen et al. (1997). Rose uses capillary gel electrophoresis to determine binding of PNAs to their complementary oligonucleotide, measuring the relative binding kinetics and stoichiometry. Similar types of measurements were made by Jensen et al. using BIAcore™ technology.

Other applications of PNAs include use in DNA strand invasion (Nielsen et al., 1991), antisense inhibition (Hanvey et al., 1992), mutational analysis (Orum et al., 1993), enhancers of transcription (Mollegaard et al., 1994), nucleic acid purification (Orum et al., 1995), isolation of transcriptionally active genes (Boffa et al., 1995), blocking of transcription factor binding (Vickers et al., 1995), genome cleavage (Veselkov et al., 1996), biosensors (Wang et al., 1996), in situ hybridization (Thisted et al., 1996), and in a alternative to Southern blotting (Perry-O'Keefe, 1996).

POLYPEPTIDE COMPOSITIONS

The present invention, in other aspects, provides polypeptide compositions. Generally, a polypeptide of the invention will be an isolated polypeptide (or an epitope, variant, or active fragment thereof) derived from a mammalian species. Preferably, the polypeptide is encoded by a polynucleotide sequence disclosed herein or a sequence which hybridizes under moderately stringent conditions to a polynucleotide sequence disclosed herein. Alternatively, the polypeptide may be defined as a polypeptide which comprises a contiguous amino acid sequence from an amino acid sequence disclosed herein, or which polypeptide comprises an entire amino acid sequence disclosed herein.

In the present invention, a polypeptide composition is also understood to comprise one or more polypeptides that are immunologically reactive with antibodies generated against a polypeptide of the invention, particularly a polypeptide having the amino acid sequence disclosed in SEQ ID NO: 324–340, 783, 786, 787, 789, 791, 793, 795, 797–799, 805, 806, 809, 827, 1667, 1670–1675, 1677–1679, 1806–1822, 1825 or to active fragments, or to variants or biological functional equivalents thereof.

Likewise, a polypeptide composition of the present invention is understood to comprise one or more polypeptides that are capable of eliciting antibodies that are immunologically reactive with one or more polypeptides encoded by one or more contiguous nucleic acid sequences contained in SEQ ID NO: 1–323, 341–782, 784–785, 788, 790, 792, 794, 796, 800–804, 807, 808, 810–826, 878–1664, 1668, 1669, 1676, 1680–1805, 1824, or to active fragments, or to variants thereof, or to one or more nucleic acid sequences which hybridize to one or more of these sequences under conditions of moderate to high stringency. Particularly illustrative polypeptides include the amino acid sequences disclosed in SEQ ID NO: 324–340, 783, 786, 787, 789, 791, 793, 795, 797–799, 805, 806, 809, 827, 1667, 1670–1675, 1677–1679, 1806–1822 and 1825.

As used herein, an active fragment of a polypeptide includes a whole or a portion of a polypeptide which is modified by conventional techniques, e.g., mutagenesis, or by addition, deletion, or substitution, but which active fragment exhibits substantially the same structure function, antigenicity, etc., as a polypeptide as described herein.

In certain illustrative embodiments, the polypeptides of the invention will comprise at least an immunogenic portion of a lung tumor protein or a variant thereof, as described herein. As noted above, a "lung tumor protein" is a protein that is expressed by lung tumor cells. Proteins that are lung tumor proteins also react detectably within an immunoassay (such as an ELISA) with antisera from a patient with lung cancer. Polypeptides as described herein may be of any length. Additional sequences derived from the native protein and/or heterologous sequences may be present, and such sequences may (but need not) possess further immunogenic or antigenic properties.

An "immunogenic portion," as used herein is a portion of a protein that is recognized (i.e., specifically bound) by a B-cell and/or T-cell surface antigen receptor. Such immunogenic portions generally comprise at least 5 amino acid residues, more preferably at least 10, and still more preferably at least 20 amino acid residues of a lung tumor protein or a variant thereof. Certain preferred immunogenic portions include peptides in which an N-terminal leader sequence and/or transmembrane domain have been deleted. Other preferred immunogenic portions may contain a small N- and/or C-terminal deletion (e.g., 1–30 amino acids, preferably 5–15 amino acids), relative to the mature protein.

Immunogenic portions may generally be identified using well known techniques, such as those summarized in Paul, *Fundamental Immunology*, 3rd ed., 243–247 (Raven Press, 1993) and references cited therein. Such techniques include screening polypeptides for the ability to react with antigen-specific antibodies, antisera and/or T-cell lines or clones. As used herein, antisera and antibodies are "antigen-specific" if they specifically bind to an antigen (i.e., they react with the protein in an ELISA or other immunoassay, and do not react detectably with unrelated proteins). Such antisera and antibodies may be prepared as described herein, and using well known techniques. An immunogenic portion of a native lung tumor protein is a portion that reacts with such antisera and/or T-cells at a level that is not substantially less than the reactivity of the full length polypeptide (e.g., in an ELISA and/or T-cell reactivity assay). Such immunogenic portions may react within such assays at a level that is similar to or greater than the reactivity of the full length polypeptide. Such screens may generally be performed using methods well known to those of ordinary skill in the art, such as those described in Harlow and Lane, *Antibodies: A Laboratory Manual*, Cold Spring Harbor Laboratory, 1988. For example, a polypeptide may be immobilized on a solid support and contacted with patient sera to allow binding of antibodies within the sera to the immobilized polypeptide. Unbound sera may then be removed and bound antibodies detected using, for example, $^{125}$I-labeled Protein A.

As noted above, a composition may comprise a variant of a native lung tumor protein. A polypeptide "variant," as used herein, is a polypeptide that differs from a native lung tumor protein in one or more substitutions, deletions, additions and/or insertions, such that the immunogenicity of the polypeptide is not substantially diminished. In other words, the ability of a variant to react with antigen-specific antisera may be enhanced or unchanged, relative to the native protein, or may be diminished by less than 50%, and preferably less than 20%, relative to the native protein. Such variants may generally be identified by modifying one of the above polypeptide sequences and evaluating the reactivity of the modified polypeptide with antigen-specific antibodies or antisera as described herein. Preferred variants include those in which one or more portions, such as an N-terminal leader sequence or transmembrane domain, have been removed. Other preferred variants include variants in which a small portion (e.g., 1–30 amino acids, preferably 5–15 amino acids) has been removed from the N- and/or C-terminal of the mature protein.

Polypeptide variants encompassed by the present invention include those exhibiting at least about 70%, 75%, 80%, 85%, 90%, 91%, 92%, 93%, 94%, 95%, 96%, 97%, 98%, or 99% or more identity (determined as described above) to the polypeptides disclosed herein.

Preferably, a variant contains conservative substitutions. A "conservative substitution" is one in which an amino acid is substituted for another amino acid that has similar properties, such that one skilled in the art of peptide chemistry would expect the secondary structure and hydropathic nature of the polypeptide to be substantially unchanged. Amino acid substitutions may generally be made on the basis of similarity in polarity, charge, solubility, hydrophobicity, hydrophilicity and/or the amphipathic nature of the residues. For example, negatively charged amino acids include aspartic acid and glutamic acid; positively charged amino acids include lysine and arginine; and amino acids with uncharged polar head groups having similar hydrophilicity values include leucine, isoleucine and valine; glycine and alanine; asparagine and glutamine; and serine, threonine, phenylalanine and tyrosine. Other groups of amino acids that may represent conservative changes include: (1) ala, pro, gly, glu, asp, gin, asn, ser, thr; (2) cys, ser, tyr, thr; (3) val, ile, leu, met, ala, phe; (4) lys, arg, his; and (5) phe, tyr, trp, his. A variant may also, or alternatively, contain nonconservative changes. In a preferred embodiment, variant polypeptides differ from a native sequence by substitution, deletion or addition of five amino acids or fewer. Variants may also (or alternatively) be modified by, for example, the deletion or addition of amino acids that have minimal influence on the immunogenicity, secondary structure and hydropathic nature of the polypeptide.

As noted above, polypeptides may comprise a signal (or leader) sequence at the N-terninal end of the protein, which co-translationally or post-translationally directs transfer of the protein. The polypeptide may also be conjugated to a linker or other sequence for ease of synthesis, purification or identification of the polypeptide (e.g., poly-His), or to enhance binding of the polypeptide to a solid support. For example, a polypeptide may be conjugated to an immunoglobulin Fc region.

Polypeptides may be prepared using any of a variety of well known techniques. Recombinant polypeptides encoded by DNA sequences as described above may be readily prepared from the DNA sequences using any of a variety of expression vectors known to those of ordinary skill in the art. Expression may be achieved in any appropriate host cell that has been transformed or transfected with an expression vector containing a DNA molecule that encodes a recombinant polypeptide. Suitable host cells include prokaryotes, yeast, and higher eukaryotic cells, such as mammalian cells and plant cells. Preferably, the host cells employed are $E.$ $coli,$ yeast or a mammalian cell line such as COS or CHO. Supernatants from suitable host/vector systems which secrete recombinant protein or polypeptide into culture media may be first concentrated using a commercially available filter. Following concentration, the concentrate may be applied to a suitable purification matrix such as an affinity matrix or an ion exchange resin. Finally, one or more reverse phase HPLC steps can be employed to further purify a recombinant polypeptide.

Portions and other variants having less than about 100 amino acids, and generally less than about 50 amino acids, may also be generated by synthetic means, using techniques well known to those of ordinary skill in the art. For example, such polypeptides may be synthesized using any of the commercially available solid-phase techniques, such as the Merrifield solid-phase synthesis method, where amino acids are sequentially added to a growing amino acid chain. See Merrifield, *J. Am. Chem. Soc.* 85:2149–2146, 1963. Equipment for automated synthesis of polypeptides is commercially available from suppliers such as Perkin Elmer/Applied BioSystems Division (Foster City, Calif.), and may be operated according to the manufacturer's instructions.

Within certain specific embodiments, a polypeptide may be a fusion protein that comprises multiple polypeptides as described herein, or that comprises at least one polypeptide as described herein and an unrelated sequence, such as a known tumor protein. A fusion partner may, for example, assist in providing T helper epitopes (an immunological fusion partner), preferably T helper epitopes recognized by humans, or may assist in expressing the protein (an expression enhancer) at higher yields than the native recombinant protein. Certain preferred fusion partners are both immunological and expression enhancing fusion partners. Other fusion partners may be selected so as to increase the solubility of the protein or to enable the protein to be targeted to desired intracellular compartments. Still further fusion partners include affinity tags, which facilitate purification of the protein.

Fusion proteins may generally be prepared using standard techniques, including chemical conjugation. Preferably, a fusion protein is expressed as a recombinant protein, allowing the production of increased levels, relative to a non-fused protein, in an expression system. Briefly, DNA sequences encoding the polypeptide components may be assembled separately, and ligated into an appropriate expression vector. The 3' end of the DNA sequence encoding one polypeptide component is ligated, with or without a peptide linker, to the 5' end of a DNA sequence encoding the second polypeptide component so that the reading frames of the sequences are in phase. This permits translation into a single fusion protein that retains the biological activity of both component polypeptides.

A peptide linker sequence may be employed to separate the first and second polypeptide components by a distance sufficient to ensure that each polypeptide folds into its secondary and tertiary structures. Such a peptide linker sequence is incorporated into the fusion protein using standard techniques well known in the art. Suitable peptide linker sequences may be chosen based on the following factors: (1) their ability to adopt a flexible extended conformation; (2) their inability to adopt a secondary structure that could interact with functional epitopes on the first and second polypeptides; and (3) the lack of hydrophobic or charged residues that might react with the polypeptide functional epitopes. Preferred peptide linker sequences contain Gly, Asn and Ser residues. Other near neutral amino acids, such as Thr and Ala may also be used in the linker sequence. Amino acid sequences which may be usefully employed as linkers include those disclosed in Maratea et al., *Gene* 40:39–46, 1985; Murphy et al., *Proc. Natl. Acad. Sci. USA* 83:8258–8262, 1986; U.S. Pat. No. 4,935,233 and U.S. Pat. No. 4,751,180. The linker sequence may generally be from 1 to about 50 amino acids in length. Linker sequences are not required when the first and second polypeptides have non-essential N-terminal amino acid regions that can be used to separate the functional domains and prevent steric interference.

The ligated DNA sequences are operably linked to suitable transcriptional or translational regulatory elements. The regulatory elements responsible for expression of DNA are located only 5' to the DNA sequence encoding the first polypeptides. Similarly, stop codons required to end translation and transcription termination signals are only present 3' to the DNA sequence encoding the second polypeptide.

Fusion proteins are also provided. Such proteins comprise a polypeptide as described herein together with an unrelated immunogenic protein. Preferably the immunogenic protein is capable of eliciting a recall response. Examples of such proteins include tetanus, tuberculosis and hepatitis proteins (see, for example, Stoute et al. New Engl. J. Med., 336:86–91, 1997).

Within preferred embodiments, an immunological fusion partner is derived from protein D, a surface protein of the gram-negative bacterium Haemophilus influenza B (WO 91/18926). Preferably, a protein D derivative comprises approximately the first third of the protein (e.g., the first N-terminal 100–110 amino acids), and a protein D derivative may be lipidated. Within certain preferred embodiments, the first 109 residues of a Lipoprotein D fusion partner is included on the N-terminus to provide the polypeptide with additional exogenous T-cell epitopes and to increase the expression level in E. coli (thus functioning as an expression enhancer). The lipid tail ensures optimal presentation of the antigen to antigen presenting cells. Other fusion partners include the non-structural protein from influenzae virus, NS1 (hemaglutinin). Typically, the N-terminal 81 amino acids are used, although different fragments that include T-helper epitopes may be used.

In another embodiment, the immunological fusion partner is the protein known as LYTA, or a portion thereof (preferably a C-terminal portion). LYTA is derived from Streptococcus pneumoniae, which synthesizes an N-acetyl-L-alanine amidase known as amidase LYTA (encoded by the LytA gene; Gene 43:265–292, 1986). LYTA is an autolysin that specifically degrades certain bonds in the peptidoglycan backbone. The C-terminal domain of the LYTA protein is responsible for the affinity to the choline or to some choline analogues such as DEAE. This property has been exploited for the development of E. coli C-LYTA expressing plasmids useful for expression of fusion proteins. Purification of hybrid proteins containing the C-LYTA fragment at the amino terminus has been described (see Biotechnology 10:795–798, 1992). Within a preferred embodiment, a repeat portion of LYTA may be incorporated into a fusion protein. A repeat portion is found in the C-terminal region starting at residue 178. A particularly preferred repeat portion incorporates residues 188–305.

In general, polypeptides (including fusion proteins) and polynucleotides as described herein are isolated. An "isolated" polypeptide or polynucleotide is one that is removed from its original environment. For example, a naturally-occurring protein is isolated if it is separated from some or all of the coexisting materials in the natural system. Preferably, such polypeptides are at least about 90% pure, more preferably at least about 95% pure and most preferably at least about 99% pure. A polynucleotide is considered to be isolated if, for example, it is cloned into a vector that is not a part of the natural environment.

BINDING AGENTS

The present invention further provides agents, such as antibodies and antigen-binding fragments thereof, that specifically bind to a lung tumor protein. As used herein, an antibody, or antigen-binding fragment thereof, is said to "specifically bind" to a lung tumor protein if it reacts at a detectable level (within, for example, an ELISA) with a lung tumor protein, and does not react detectably with unrelated proteins under similar conditions. As used herein, "binding" refers to a noncovalent association between two separate molecules such that a complex is formed. The ability to bind may be evaluated by, for example, determining a binding constant for the formation of the complex. The binding constant is the value obtained when the concentration of the complex is divided by the product of the component concentrations. In general, two compounds are said to "bind," in the context of the present invention, when the binding constant for complex formation exceeds about $10^3$ L/mol. The binding constant may be determined using methods well known in the art.

Binding agents may be further capable of differentiating between patients with and without a cancer, such as lung cancer, using the representative assays provided herein. In other words, antibodies or other binding agents that bind to a lung tumor protein will generate a signal indicating the presence of a cancer in at least about 20% of patients with the disease, and will generate a negative signal indicating the absence of the disease in at least about 90% of individuals without the cancer. To determine whether a binding agent satisfies this requirement, biological samples (e.g., blood, sera, sputum, urine and/or tumor biopsies) from patients with and without a cancer (as determined using standard clinical tests) may be assayed as described herein for the presence of polypeptides that bind to the binding agent. It will be apparent that a statistically significant number of samples with and without the disease should be assayed. Each binding agent should satisfy the above criteria; however, those of ordinary skill in the art will recognize that binding agents may be used in combination to improve sensitivity.

Any agent that satisfies the above requirements may be a binding agent. For example, a binding agent may be a ribosome, with or without a peptide component, an RNA molecule or a polypeptide. In a preferred embodiment, a binding agent is an antibody or an antigen-binding fragment thereof. Antibodies may be prepared by any of a variety of techniques known to those of ordinary skill in the art. See, e.g., Harlow and Lane, Antibodies: A Laboratory Manual, Cold Spring Harbor Laboratory, 1988. In general, antibodies can be produced by cell culture techniques, including the generation of monoclonal antibodies as described herein, or via transfection of antibody genes into suitable bacterial or mammalian cell hosts, in order to allow for the production of recombinant antibodies. In one technique, an immunogen comprising the polypeptide is initially injected into any of a wide variety of mammals (e.g., mice, rats, rabbits, sheep or goats). In this step, the polypeptides of this invention may serve as the immunogen without modification. Alternatively, particularly for relatively short polypeptides, a superior immune response may be elicited if the polypeptide is joined to a carrier protein, such as bovine serum albumin or keyhole limpet hemocyanin. The immunogen is injected into the animal host, preferably according to a predetermined schedule incorporating one or more booster immunizations, and the animals are bled periodically. Polyclonal antibodies specific for the polypeptide may then be purified from such antisera by, for example, affinity chromatography using the polypeptide coupled to a suitable solid support.

Monoclonal antibodies specific for an antigenic polypeptide of interest may be prepared, for example, using the technique of Kohler and Milstein, *Eur. J. Immunol.* 6:511–519, 1976, and improvements thereto. Briefly, these methods involve the preparation of immortal cell lines capable of producing antibodies having the desired specificity (i.e., reactivity with the polypeptide of interest). Such cell lines may be produced, for example, from spleen cells obtained from an animal immunized as described above. The spleen cells are then immortalized by, for example, fusion with a myeloma cell fusion partner, preferably one that is syngeneic with the immunized animal. A variety of fusion techniques may be employed. For example, the spleen cells and myeloma cells may be combined with a nonionic detergent for a few minutes and then plated at low density on a selective medium that supports the growth of hybrid cells, but not myeloma cells. A preferred selection technique uses HAT (hypoxanthine, aminopterin, thymidine) selection. After a sufficient time, usually about 1 to 2 weeks, colonies of hybrids are observed. Single colonies are selected and their culture supernatants tested for binding activity against the polypeptide. Hybridomas having high reactivity and specificity are preferred.

Monoclonal antibodies may be isolated from the supernatants of growing hybridoma colonies. In addition, various techniques may be employed to enhance the yield, such as injection of the hybridoma cell line into the peritoneal cavity of a suitable vertebrate host, such as a mouse. Monoclonal antibodies may then be harvested from the ascites fluid or the blood. Contaminants may be removed from the antibodies by conventional techniques, such as chromatography, gel filtration, precipitation, and extraction. The polypeptides of this invention may be used in the purification process in, for example, an affinity chromatography step.

Within certain embodiments, the use of antigen-binding fragments of antibodies may be preferred. Such fragments include Fab fragments, which may be prepared using standard techniques. Briefly, immunoglobulins may be purified from rabbit serum by affinity chromatography on Protein A bead columns (Harlow and Lane, *Antibodies: A Laboratory Manual,* Cold Spring Harbor Laboratory, 1988) and digested by papain to yield Fab and Fc fragments. The Fab and Fc fragments may be separated by affinity chromatography on protein A bead columns.

Monoclonal antibodies of the present invention may be coupled to one or more therapeutic agents. Suitable agents in this regard include radionuclides, differentiation inducers, drugs, toxins, and derivatives thereof. Preferred radionuclides include $^{90}Y$, $^{123}I$, $^{125}I$, $^{131}I$, $^{186}Re$, $^{188}Re$, $^{211}At$, and $^{212}Bi$. Preferred drugs include methotrexate, and pyrimidine and purine analogs. Preferred differentiation inducers include phorbol esters and butyric acid. Preferred toxins include ricin, abrin, diptheria toxin, cholera toxin, gelonin, Pseudomonas exotoxin, Shigella toxin, and pokeweed antiviral protein.

A therapeutic agent may be coupled (e.g., covalently bonded) to a suitable monoclonal antibody either directly or indirectly (e.g., via a linker group). A direct reaction between an agent and an antibody is possible when each possesses a substituent capable of reacting with the other. For example, a nucleophilic group, such as an amino or sulfhydryl group, on one may be capable of reacting with a carbonyl-containing group, such as an anhydride or an acid halide, or with an alkyl group containing a good leaving group (e.g., a halide) on the other.

Alternatively, it may be desirable to couple a therapeutic agent and an antibody via a linker group. A linker group can function as a spacer to distance an antibody from an agent in order to avoid interference with binding capabilities. A linker group can also serve to increase the chemical reactivity of a substituent on an agent or an antibody, and thus increase the coupling efficiency. An increase in chemical reactivity may also facilitate the use of agents, or functional groups on agents, which otherwise would not be possible.

It will be evident to those skilled in the art that a variety of bifunctional or polyfunctional reagents, both homo- and hetero-functional (such as those described in the catalog of the Pierce Chemical Co., Rockford, Ill.), may be employed as the linker group. Coupling may be effected, for example, through amino groups, carboxyl groups, sulfhydryl groups or oxidized carbohydrate residues. There are numerous references describing such methodology, e.g., U.S. Pat. No. 4,671,958, to Rodwell et al.

Where a therapeutic agent is more potent when free from the antibody portion of the immunoconjugates of the present invention, it may be desirable to use a linker group which is cleavable during or upon internalization into a cell. A number of different cleavable linker groups have been described. The mechanisms for the intracellular release of an agent from these linker groups include cleavage by reduction of a disulfide bond (e.g., U.S. Pat. No. 4,489,710, to Spitler), by irradiation of a photolabile bond (e.g., U.S. Pat. No. 4,625,014, to Senter et al.), by hydrolysis of derivatized amino acid side chains (e.g., U.S. Pat. No. 4,638,045, to Kohn et al.), by serum complement-mediated hydrolysis (e.g., U.S. Pat. No. 4,671,958, to Rodwell et al.), and acid-catalyzed hydrolysis (e.g., U.S. Pat. No. 4,569,789, to Blattler et al.).

It may be desirable to couple more than one agent to an antibody. In one embodiment, multiple molecules of an agent are coupled to one antibody molecule. In another embodiment, more than one type of agent may be coupled to one antibody. Regardless of the particular embodiment, immunoconjugates with more than one agent may be prepared in a variety of ways. For example, more than one agent may be coupled directly to an antibody molecule, or linkers that provide multiple sites for attachment can be used. Alternatively, a carrier can be used.

A carrier may bear the agents in a variety of ways, including covalent bonding either directly or via a linker group. Suitable carriers include proteins such as albumins (e.g., U.S. Pat. No. 4,507,234, to Kato et al.), peptides and polysaccharides such as aminodextran (e.g., U.S. Pat. No. 4,699,784, to Shih et al.). A carrier may also bear an agent by noncovalent bonding or by encapsulation, such as within a liposome vesicle (e.g., U.S. Pat. Nos. 4,429,008 and 4,873,088). Carriers specific for radionuclide agents include radiohalogenated small molecules and chelating compounds. For example, U.S. Pat. No. 4,735,792 discloses representative radiohalogenated small molecules and their synthesis. A radionuclide chelate may be formed from chelating compounds that include those containing nitrogen and sulfur atoms as the donor atoms for binding the metal, or metal oxide, radionuclide. For example, U.S. Pat. No. 4,673,562, to Davison et al. discloses representative chelating compounds and their synthesis.

A variety of routes of administration for the antibodies and immunoconjugates may be used. Typically, administration will be intravenous, intramuscular, subcutaneous or in the bed of a resected tumor. It will be evident that the precise dose of the antibody/immunoconjugate will vary depending upon the antibody used, the antigen density on the tumor, and the rate of clearance of the antibody.

T CELLS

Immunotherapeutic compositions may also, or alternatively, comprise T cells specific for a lung tumor protein. Such cells may generally be prepared in vitro or ex vivo, using standard procedures. For example, T cells may be isolated from bone marrow, peripheral blood, or a fraction of bone marrow or peripheral blood of a patient, using a commercially available cell separation system, such as the Isolex™ System, available from Nexell Therapeutics, Inc. (Irvine, Calif.; see also U.S. Pat. No. 5,240,856; U.S. Pat. No. 5,215,926; WO 89/06280; WO 91/16116 and WO 92/07243). Alternatively, T cells may be derived from related or unrelated humans, non-human mammals, cell lines or cultures.

T cells may be stimulated with a lung tumor polypeptide, polynucleotide encoding a lung tumor polypeptide and/or an antigen presenting cell (APC) that expresses such a polypeptide. Such stimulation is performed under conditions and for a time sufficient to permit the generation of T cells that are specific for the polypeptide. Preferably, a lung tumor polypeptide or polynucleotide is present within a delivery vehicle, such as a microsphere, to facilitate the generation of specific T cells.

T cells are considered to be specific for a lung tumor polypeptide if the T cells specifically proliferate, secrete cytokines or kill target cells coated with the polypeptide or expressing a gene encoding the polypeptide. T cell specificity may be evaluated using any of a variety of standard techniques. For example, within a chromium release assay or proliferation assay, a stimulation index of more than two fold increase in lysis and/or proliferation, compared to negative controls, indicates T cell specificity. Such assays may be performed, for example, as described in Chen et al., Cancer Res. 54:1065–1070, 1994. Alternatively, detection of the proliferation of T cells may be accomplished by a variety of known techniques. For example, T cell proliferation can be detected by measuring an increased rate of DNA synthesis (e.g., by pulse-labeling cultures of T cells with tritiated thymidine and measuring the amount of tritiated thymidine incorporated into DNA). Contact with a lung tumor polypeptide (100 ng/ml–100 µg/ml, preferably 200 ng/ml–25 µg/ml) for 3–7 days should result in at least a two fold increase in proliferation of the T cells. Contact as described above for 2–3 hours should result in activation of the T cells, as measured using standard cytokine assays in which a two fold increase in the level of cytokine release (e.g., TNF or IFN-γ) is indicative of T cell activation (see Coligan et al., Current Protocols in Immunology, vol. 1, Wiley Interscience (Greene 1998)). T cells that have been activated in response to a lung tumor polypeptide, polynucleotide or polypeptide-expressing APC may be CD4$^+$ and/or CD8$^+$. Lung tumor protein-specific T cells may be expanded using standard techniques. Within preferred embodiments, the T cells are derived from a patient, a related donor or an unrelated donor, and are administered to the patient following stimulation and expansion.

For therapeutic purposes, CD4$^+$ or CD8$^+$ T cells that proliferate in response to a lung tumor polypeptide, polynucleotide or APC can be expanded in number either in vitro or in vivo. Proliferation of such T cells in vitro may be accomplished in a variety of ways. For example, the T cells can be re-exposed to a lung tumor polypeptide, or a short peptide corresponding to an immunogenic portion of such a polypeptide, with or without the addition of T cell growth factors, such as interleukin-2, and/or stimulator cells that synthesize a lung tumor polypeptide. Alternatively, one or more T cells that proliferate in the presence of a lung tumor protein can be expanded in number by cloning. Methods for cloning cells are well known in the art, and include limiting dilution.

PHARMACEUTICAL COMPOSITIONS

In additional embodiments, the present invention concerns formulation of one or more of the polynucleotide, polypeptide, T-cell and/or antibody compositions disclosed herein in pharmaceutically-acceptable solutions for administration to a cell or an animal, either alone, or in combination with one or more other modalities of therapy.

It will also be understood that, if desired, the nucleic acid segment, RNA, DNA or PNA compositions that express a polypeptide as disclosed herein may be administered in combination with other agents as well, such as, e.g., other proteins or polypeptides or various pharmaceutically-active agents. In fact, there is virtually no limit to other components that may also be included, given that the additional agents do not cause a significant adverse effect upon contact with the target cells or host tissues. The compositions may thus be delivered along with various other agents as required in the particular instance. Such compositions may be purified from host cells or other biological sources, or alternatively may be chemically synthesized as described herein. Likewise, such compositions may further comprise substituted or derivatized RNA or DNA compositions.

Formulation of pharmaceutically-acceptable excipients and carrier solutions is well-known to those of skill in the art, as is the development of suitable dosing and treatment regimens for using the particular compositions described herein in a variety of treatment regimens, including e.g., oral, parenteral, intravenous, intranasal, and intramuscular administration and formulation.

1. ORAL DELIVERY

In certain applications, the pharmaceutical compositions disclosed herein may be delivered via oral administration to an animal. As such, these compositions may be formulated with an inert diluent or with an assimilable edible carrier, or they may be enclosed in hard- or soft-shell gelatin capsule, or they may be compressed into tablets, or they may be incorporated directly with the food of the diet.

The active compounds may even be incorporated with excipients and used in the form of ingestible tablets, buccal tables, troches, capsules, elixirs, suspensions, syrups, wafers, and the like (Mathiowitz et al., 1997; Hwang et al., 1998; U.S. Pat. No. 5,641,515; U.S. Pat. No. 5,580,579 and U.S. Pat. No. 5,792,451, each specifically incorporated herein by reference in its entirety). The tablets, troches, pills, capsules and the like may also contain the following: a binder, as gum tragacanth, acacia, cornstarch, or gelatin; excipients, such as dicalcium phosphate; a disintegrating agent, such as corn starch, potato starch, alginic acid and the like; a lubricant, such as magnesium stearate; and a sweetening agent, such as sucrose, lactose or saccharin may be added or a flavoring agent, such as peppermint, oil of wintergreen, or cherry flavoring. When the dosage unit form is a capsule, it may contain, in addition to materials of the above type, a liquid carrier. Various other materials may be present as coatings or to otherwise modify the physical form of the dosage unit. For instance, tablets, pills, or capsules may be coated with shellac, sugar, or both. A syrup of elixir may contain the active compound sucrose as a sweetening agent methyl and propylparabens as preservatives, a dye and flavoring, such as cherry or orange flavor. Of course, any material used in preparing any dosage unit form should be pharmaceutically pure and substantially non-toxic in the amounts employed. In addition, the active compounds may be incorporated into sustained-release preparation and formulations.

Typically, these formulations may contain at least about 0.1% of the active compound or more, although the percentage of the active ingredient(s) may, of course, be varied and may conveniently be between about 1 or 2% and about 60% or 70% or more of the weight or volume of the total formulation. Naturally, the amount of active compound(s) in each therapeutically useful composition may be prepared is such a way that a suitable dosage will be obtained in any given unit dose of the compound. Factors such as solubility, bioavailability, biological half-life, route of administration, product shelf life, as well as other pharmacological considerations will be contemplated by one skilled in the art of preparing such pharmaceutical formulations, and as such, a variety of dosages and treatment regimens may be desirable.

For oral administration the compositions of the present invention may alternatively be incorporated with one or more excipients in the form of a mouthwash, dentifrice, buccal tablet, oral spray, or sublingual orally-administered formulation. For example, a mouthwash may be prepared incorporating the active ingredient in the required amount in an appropriate solvent, such as a sodium borate solution (Dobell's Solution). Alternatively, the active ingredient may be incorporated into an oral solution such as one containing sodium borate, glycerin and potassium bicarbonate, or dispersed in a dentifrice, or added in a therapeutically-effective amount to a composition that may include water, binders, abrasives, flavoring agents, foaming agents, and humectants. Alternatively the compositions may be fashioned into a tablet or solution form that may be placed under the tongue or otherwise dissolved in the mouth.

2. INJECTABLE DELIVERY

In certain circumstances it will be desirable to deliver the pharmaceutical compositions disclosed herein parenterally, intravenously, intramuscularly, or even intraperitoneally as described in U.S. Pat. No. 5,543,158; U.S. Pat. No. 5,641, 515 and U.S. Pat. No. 5,399,363 (each specifically incorporated herein by reference in its entirety). Solutions of the active compounds as free base or pharmacologically acceptable salts may be prepared in water suitably mixed with a surfactant, such as hydroxypropylcellulose. Dispersions may also be prepared in glycerol, liquid polyethylene glycols, and mixtures thereof and in oils. Under ordinary conditions of storage and use, these preparations contain a preservative to prevent the growth of microorganisms.

The pharmaceutical forms suitable for injectable use include sterile aqueous solutions or dispersions and sterile powders for the extemporaneous preparation of sterile injectable solutions or dispersions (U.S. Pat. No. 5,466,468, specifically incorporated herein by reference in its entirety). In all cases the form must be sterile and must be fluid to the extent that easy syringability exists. It must be stable under the conditions of manufacture and storage and must be preserved against the contaminating action of microorganisms, such as bacteria and fungi. The carrier can be a solvent or dispersion medium containing, for example, water, ethanol, polyol (e.g., glycerol, propylene glycol, and liquid polyethylene glycol, and the like), suitable mixtures thereof, and/or vegetable oils. Proper fluidity may be maintained, for example, by the use of a coating, such as lecithin, by the maintenance of the required particle size in the case of dispersion and by the use of surfactants. The prevention of the action of microorganisms can be facilitated by various antibacterial and antifungal agents, for example, parabens, chlorobutanol, phenol, sorbic acid, thimerosal, and the like. In many cases, it will be preferable to include isotonic agents, for example, sugars or sodium chloride. Prolonged absorption of the injectable compositions can be brought about by the use in the compositions of agents delaying absorption, for example, aluminum monostearate and gelatin.

For parenteral administration in an aqueous solution, for example, the solution should be suitably buffered if necessary and the liquid diluent first rendered isotonic with sufficient saline or glucose. These particular aqueous solutions are especially suitable for intravenous, intramuscular, subcutaneous and intraperitoneal administration. In this connection, a sterile aqueous medium that can be employed will be known to those of skill in the art in light of the present disclosure. For example, one dosage may be dissolved in 1 ml of isotonic NaCl solution and either added to 1000 ml of hypodermoclysis fluid or injected at the proposed site of infusion, (see for example, "Remington's Pharmaceutical Sciences" 15th Edition, pages 1035–1038 and 1570–1580). Some variation in dosage will necessarily occur depending on the condition of the subject being treated. The person responsible for administration will, in any event, determine the appropriate dose for the individual subject. Moreover, for human administration, preparations should meet sterility, pyrogenicity, and the general safety and purity standards as required by FDA Office of Biologics standards.

Sterile injectable solutions are prepared by incorporating the active compounds in the required amount in the appropriate solvent with various of the other ingredients enumerated above, as required, followed by filtered sterilization. Generally, dispersions are prepared by incorporating the various sterilized active ingredients into a sterile vehicle which contains the basic dispersion medium and the required other ingredients from those enumerated above. In the case of sterile powders for the preparation of sterile injectable solutions, the preferred methods of preparation are vacuum-drying and freeze-drying techniques which yield a powder of the active ingredient plus any additional desired ingredient from a previously sterile-filtered solution thereof.

The compositions disclosed herein may be formulated in a neutral or salt form. Pharmaceutically-acceptable salts, include the acid addition salts (formed with the free amino groups of the protein) and which are formed with inorganic acids such as, for example, hydrochloric or phosphoric acids, or such organic acids as acetic, oxalic, tartaric, mandelic, and the like. Salts formed with the free carboxyl groups can also be derived from inorganic bases such as, for example, sodium, potassium, ammonium, calcium, or ferric hydroxides, and such organic bases as isopropylamine, trimethylamine, histidine, procaine and the like. Upon formulation, solutions will be administered in a manner compatible with the dosage formulation and in such amount as is therapeutically effective. The formulations are easily administered in a variety of dosage forms such as injectable solutions, drug-release capsules, and the like.

As used herein, "carrier" includes any and all solvents, dispersion media, vehicles, coatings, diluents, antibacterial and antifungal agents, isotonic and absorption delaying agents, buffers, carrier solutions, suspensions, colloids, and the like. The use of such media and agents for pharmaceutical active substances is well known in the art. Except insofar as any conventional media or agent is incompatible with the active ingredient, its use in the therapeutic compositions is contemplated. Supplementary active ingredients can also be incorporated into the compositions.

The phrase "pharmaceutically-acceptable" refers to molecular entities and compositions that do not produce an allergic or similar untoward reaction when administered to a human. The preparation of an aqueous composition that contains a protein as an active ingredient is well understood in the art. Typically, such compositions are prepared as injectables, either as liquid solutions or suspensions; solid forms suitable for solution in, or suspension in, liquid prior to injection can also be prepared. The preparation can also be emulsified.

3. NASAL DELIVERY

In certain embodiments, the pharmaceutical compositions may be delivered by intranasal sprays, inhalation, and/or other aerosol delivery vehicles. Methods for delivering genes, nucleic acids, and peptide compositions directly to the lungs via nasal aerosol sprays has been described e.g., in U.S. Pat. No. 5,756,353 and U.S. Pat. No. 5,804,212 (each specifically incorporated herein by reference in its entirety). Likewise, the delivery of drugs using intranasal microparticle resins (Takenaga et al., 1998) and lysophosphatidylglycerol compounds (U.S. Pat. No. 5,725,871, specifically incorporated herein by reference in its entirety) are also well-known in the pharmaceutical arts. Likewise, transmucosal drug delivery in the form of a polytetrafluoroetheylene support matrix is described in U.S. Pat. No. 5,780,045 (specifically incorporated herein by reference in its entirety).

4. LIPOSOME-, NANOCAPSULE-, AND MICROPARTICLE-MEDIATED DELIVERY

In certain embodiments, the inventors contemplate the use of liposomes, nanocapsules, microparticles, microspheres, lipid particles, vesicles, and the like, for the introduction of the compositions of the present invention into suitable host cells. In particular, the compositions of the present invention may be formulated for delivery either encapsulated in a lipid particle, a liposome, a vesicle, a nanosphere, or a nanoparticle or the like.

Such formulations may be preferred for the introduction of pharmaceutically-acceptable formulations of the nucleic acids or constructs disclosed herein. The formation and use of liposomes is generally known to those of skill in the art (see for example, Couvreur et al., 1977; Couvreur, 1988; Lasic, 1998; which describes the use of liposomes and nanocapsules in the targeted antibiotic therapy for intracellular bacterial infections and diseases). Recently, liposomes were developed with improved serum stability and circulation half-times (Gabizon and Papahadjopoulos, 1988; Allen and Choun, 1987; U.S. Pat. No. 5,741,516, specifically incorporated herein by reference in its entirety). Further, various methods of liposome and liposome like preparations as potential drug carriers have been reviewed (Takakura, 1998; Chandran et al., 1997; Margalit, 1995; U.S. Pat. No. 5,567,434; U.S. Pat. No. 5,552,157; U.S. Pat. No. 5,565,213; U.S. Pat. No. 5,738,868 and U.S. Pat. No. 5,795,587, each specifically incorporated herein by reference in its entirety).

Liposomes have been used successfully with a number of cell types that are normally resistant to transfection by other procedures including T cell suspensions, primary hepatocyte cultures and PC 12 cells (Renneisen et al., 1990; Muller et al., 1990). In addition, liposomes are free of the DNA length constraints that are typical of viral-based delivery systems. Liposomes have been used effectively to introduce genes, drugs (Heath and Martin, 1986; Heath et al., 1986; Balazsovits et al., 1989; Fresta and Puglisi, 1996), radiotherapeutic agents (Pikul et al., 1987), enzymes (Imaizumi et al., 1990a; Imaizumi et al., 1990b), viruses (Faller and Baltimore, 1984), transcription factors and allosteric effectors (Nicolau and Gersonde, 1979) into a variety of cultured cell lines and animals. In addition, several successful clinical trails examining the effectiveness of liposome-mediated drug delivery have been completed (Lopez-Berestein et al., 1985a; 1985b; Coune, 1988; Sculier et al., 1988). Furthermore, several studies suggest that the use of liposomes is not associated with autoimmune responses, toxicity or gonadal localization after systemic delivery (Mori and Fukatsu, 1992).

Liposomes are formed from phospholipids that are dispersed in an aqueous medium and spontaneously form multilamellar concentric bilayer vesicles (also termed multilamellar vesicles (MLVs). MLVs generally have diameters of from 25 nm to 4 $\mu$m. Sonication of MLVs results in the formation of small unilamellar vesicles (SUVs) with diameters in the range of 200 to 500 Å, containing an aqueous solution in the core.

Liposomes bear resemblance to cellular membranes and are contemplated for use in connection with the present invention as carriers for the peptide compositions. They are widely suitable as both water- and lipid-soluble substances can be entrapped, i.e. in the aqueous spaces and within the bilayer itself, respectively. It is possible that the drug-bearing liposomes may even be employed for site-specific delivery of active agents by selectively modifying the liposomal formulation.

In addition to the teachings of Couvreur et al. (1977; 1988), the following information may be utilized in generating liposomal formulations. Phospholipids can form a variety of structures other than liposomes when dispersed in water, depending on the molar ratio of lipid to water. At low ratios the liposome is the preferred structure. The physical characteristics of liposomes depend on pH, ionic strength and the presence of divalent cations. Liposomes can show low permeability to ionic and polar substances, but at elevated temperatures undergo a phase transition which markedly alters their permeability. The phase transition involves a change from a closely packed, ordered structure, known as the gel state, to a loosely packed, less-ordered structure, known as the fluid state. This occurs at a characteristic phase-transition temperature and results in an increase in permeability to ions, sugars and drugs.

In addition to temperature, exposure to proteins can alter the permeability of liposomes. Certain soluble proteins, such as cytochrome c, bind, deform and penetrate the bilayer, thereby causing changes in permeability. Cholesterol inhibits this penetration of proteins, apparently by packing the phospholipids more tightly. It is contemplated that the most useful liposome formations for antibiotic and inhibitor delivery will contain cholesterol.

The ability to trap solutes varies between different types of liposomes. For example, MLVs are moderately efficient at trapping solutes, but SUVs are extremely inefficient. SUVs offer the advantage of homogeneity and reproducibility in size distribution, however, and a compromise between size and trapping efficiency is offered by large unilamellar vesicles (LUVs). These are prepared by ether evaporation and are three to four times more efficient at solute entrapment than MLVs.

In addition to liposome characteristics, an important determinant in entrapping compounds is the physicochemical properties of the compound itself. Polar compounds are trapped in the aqueous spaces and nonpolar compounds bind to the lipid bilayer of the vesicle. Polar compounds are released through permeation or when the bilayer is broken, but nonpolar compounds remain affiliated with the bilayer unless it is disrupted by temperature or exposure to lipoproteins. Both types show maximum efflux rates at the phase transition temperature.

Liposomes interact with cells via four different mechanisms: endocytosis by phagocytic cells of the reticuloendothelial system such as macrophages and neutrophils; adsorption to the cell surface, either by nonspecific weak hydrophobic or electrostatic forces, or by specific interactions with cell-surface components; fusion with the plasma cell membrane by insertion of the lipid bilayer of the liposome into the plasma membrane, with simultaneous release of liposomal contents into the cytoplasm; and by transfer of liposomal lipids to cellular or subcellular membranes, or vice versa, without any association of the liposome contents. It often is difficult to determine which mechanism is operative and more than one may operate at the same time.

The fate and disposition of intravenously injected liposomes depend on their physical properties, such as size, fluidity, and surface charge. They may persist in tissues for h or days, depending on their composition, and half lives in the blood range from min to several h. Larger liposomes, such as MLVs and LUVs, are taken up rapidly by phagocytic cells of the reticuloendothelial system, but physiology of the circulatory system restrains the exit of such large species at most sites. They can exit only in places where large openings or pores exist in the capillary endothelium, such as the sinusoids of the liver or spleen. Thus, these organs are the predominate site of uptake. On the other hand, SUVs show a broader tissue distribution but still are sequestered highly in the liver and spleen. In general, this in vivo behavior limits the potential targeting of liposomes to only those organs and tissues accessible to their large size. These include the blood, liver, spleen, bone marrow, and lymphoid organs.

Targeting is generally not a limitation in terms of the present invention. However, should specific targeting be desired, methods are available for this to be accomplished. Antibodies may be used to bind to the liposome surface and to direct the antibody and its drug contents to specific antigenic receptors located on a particular cell-type surface. Carbohydrate determinants (glycoprotein or glycolipid cell-surface components that play a role in cell-cell recognition, interaction and adhesion) may also be used as recognition sites as they have potential in directing liposomes to particular cell types. Mostly, it is contemplated that intravenous injection of liposomal preparations would be used, but other routes of administration are also conceivable.

Alternatively, the invention provides for pharmaceutically-acceptable nanocapsule formulations of the compositions of the present invention. Nanocapsules can generally entrap compounds in a stable and reproducible way (Henry-Michelland et al., 1987; Quintanar-Guerrero et al., 1998; Douglas et al., 1987). To avoid side effects due to intracellular polymeric overloading, such ultrafine particles (sized around 0.1 $\mu$m) should be designed using polymers able to be degraded in vivo. Biodegradable polyalkylcyanoacrylate nanoparticles that meet these requirements are contemplated for use in the present invention. Such particles may be are easily made, as described (Couvreur et al., 1980; 1988; zur Muhlen et al., 1998; Zambaux et al. 1998; Pinto-Alphandry et al., 1995 and U.S. Pat. No. 5,145,684, specifically incorporated herein by reference in its entirety).

IMMUNOGENIC COMPOSITIONS

In certain preferred embodiments of the present invention, immunogenic compositions, or vaccines, are provided. The immunogenic compositions will generally comprise one or more pharmaceutical compositions, such as those discussed above, in combination with an immunostimulant. An immunostimulant may be any substance that enhances or potentiates an immune response (antibody and/or cell-mediated) to an exogenous antigen. Examples of immunostimulants include adjuvants, biodegradable microspheres (e.g., polylactic galactide) and liposomes (into which the compound is incorporated; see e.g., Fullerton, U.S. Pat. No. 4,235,877). Vaccine preparation is generally described in, for example, M. F. Powell and M. J. Newman, eds., "Vaccine Design (the subunit and adjuvant approach)," Plenum Press (NY, 1995). Pharmaceutical compositions and immunogenic compositions, or vaccines, within the scope of the present invention may also contain other compounds, which may be biologically active or inactive. For example, one or more immunogenic portions of other tumor antigens may be present, either incorporated into a fusion polypeptide or as a separate compound, within the composition.

Illustrative immunogenic compositions may contain DNA encoding one or more of the polypeptides as described above, such that the polypeptide is generated in situ. As noted above, the DNA may be present within any of a variety of delivery systems known to those of ordinary skill in the art, including nucleic acid expression systems, bacteria and viral expression systems. Numerous gene delivery techniques are well known in the art, such as those described by Rolland, *Crit. Rev. Therap. Drug Carrier Systems* 15:143–198, 1998, and references cited therein. Appropriate nucleic acid expression systems contain the necessary DNA sequences for expression in the patient (such as a suitable promoter and terminating signal). Bacterial delivery systems involve the administration of a bacterium (such as Bacillus-Calmette-Guerrin) that expresses an immunogenic portion of the polypeptide on its cell surface or secretes such an epitope. In a preferred embodiment, the DNA may be introduced using a viral expression system (e.g., vaccinia or other pox virus, retrovirus, or adenovirus), which may involve the use of a non-pathogenic (defective), replication competent virus. Suitable systems are disclosed, for example, in Fisher-Hoch et al., *Proc. Natl. Acad. Sci. USA* 86:317–321, 1989; Flexner et al., *Ann. N.Y. Acad. Sci.* 569:86–103, 1989; Flexner et al., *Vaccine* 8:17–21, 1990; U.S. Pat. Nos. 4,603,112, 4,769,330, and 5,017,487; WO 89/01973; U.S. Pat. No. 4,777,127; GB 2,200,651; EP 0,345,242; WO 91/02805; Berkner, *Biotechniques* 6:616–627, 1988; Rosenfeld et al., *Science* 252:431–434, 1991; Kolls et al., *Proc. Natl. Acad. Sci. USA* 91:215–219, 1994; Kass-Eisler et al., *Proc. Natl. Acad. Sci. USA* 90:11498–11502, 1993; Guzman et al., *Circulation* 88:2838–2848, 1993; and Guzman et al., *Cir. Res.* 73:1202–1207, 1993. Techniques for incorporating DNA into such expression systems are well known to those of ordinary skill in the art. The DNA may also be "naked," as described, for example, in Ulmer et al., *Science* 259:1745–1749, 1993 and reviewed by Cohen, *Science* 259:1691–1692, 1993. The uptake of naked DNA may be increased by coating the DNA onto biodegradable beads, which are efficiently transported into the cells. It will be apparent that an immunogenic composition may comprise both a polynucleotide and a polypeptide component. Such immunogenic compositions may provide for an enhanced immune response.

It will be apparent that an immunogenic composition may contain pharmaceutically acceptable salts of the polynucleotides and polypeptides provided herein. Such salts may be prepared from pharmaceutically acceptable non-toxic bases, including organic bases (e.g., salts of primary, secondary and tertiary amines and basic amino acids) and inorganic bases (e.g., sodium, potassium, lithium, ammonium, calcium and magnesium salts).

While any suitable carrier known to those of ordinary skill in the art may be employed in the immunogenic compositions of this invention, the type of carrier will vary depending on the mode of administration. Compositions of the present invention may be formulated for any appropriate manner of administration, including for example, topical, oral, nasal, intravenous, intracranial, intraperitoneal, subcutaneous or intramuscular administration. For parenteral administration, such as subcutaneous injection, the carrier preferably comprises water, saline, alcohol, a fat, a wax or a buffer. For oral administration, any of the above carriers or a solid carrier, such as mannitol, lactose, starch, magnesium stearate, sodium saccharine, talcum, cellulose, glucose, sucrose, and magnesium carbonate, may be employed. Biodegradable microspheres (e.g., polylactate polyglycolate) may also be employed as carriers for the pharmaceutical compositions of this invention. Suitable biodegradable microspheres are disclosed, for example, in U.S. Pat. Nos. 4,897,268; 5,075,109; 5,928,647; 5,811,128; 5,820,883; 5,853,763; 5,814,344 and 5,942,252. One may also employ a carrier comprising the particulate-protein complexes described in U.S. Pat. No. 5,928,647, which are capable of inducing a class I-restricted cytotoxic T lymphocyte responses in a host.

Such compositions may also comprise buffers (e.g., neutral buffered saline or phosphate buffered saline), carbohydrates (e.g., glucose, mannose, sucrose or dextrans), mannitol, proteins, polypeptides or amino acids such as glycine, antioxidants, bacteriostats, chelating agents such as EDTA or glutathione, adjuvants (e.g., aluminum hydroxide), solutes that render the formulation isotonic, hypotonic or weakly hypertonic with the blood of a recipient, suspending agents, thickening agents and/or preservatives. Alternatively, compositions of the present invention may be formulated as a lyophilizate. Compounds may also be encapsulated within liposomes using well known technology.

Any of a variety of immunostimulants may be employed in the immunogenic compositions of this invention. For example, an adjuvant may be included. Most adjuvants contain a substance designed to protect the antigen from rapid catabolism, such as aluminum hydroxide or mineral oil, and a stimulator of immune responses, such as lipid A, *Bortadella pertussis* or *Mycobacterium tuberculosis* derived proteins. Suitable adjuvants are commercially available as, for example, Freund's Incomplete Adjuvant and Complete Adjuvant (Difco Laboratories, Detroit, Mich.); Merck Adjuvant 65 (Merck and Company, Inc., Rahway, N.J.); AS-2 (SmithKline Beecham, Philadelphia, Pa.); aluminum salts such as aluminum hydroxide gel (alum) or aluminum phosphate; salts of calcium, iron or zinc; an insoluble suspension of acylated tyrosine; acylated sugars; cationically or anionically derivatized polysaccharides; polyphosphazenes; biodegradable microspheres; monophosphoryl lipid A and quil A. Cytokines, such as GM-CSF or interleukin-2, -7, or -12, may also be used as adjuvants.

Within the immunogenic compositions provided herein, the adjuvant composition is preferably designed to induce an immune response predominantly of the Th1 type. High levels of Th1-type cytokines (e.g., IFN-$\gamma$, TNF$\alpha$, IL-2 and IL-12) tend to favor the induction of cell mediated immune responses to an administered antigen. In contrast, high levels of Th2-type cytokines (e.g., IL-4, IL-5, IL-6 and IL-10) tend to favor the induction of humoral immune responses. Following application of an immunogenic composition as provided herein, a patient will support an immune response that includes Th1- and Th2-type responses. Within a preferred embodiment, in which a response is predominantly Th1-type, the level of Th1-type cytokines will increase to a greater extent than the level of Th2-type cytokines. The levels of these cytokines may be readily assessed using standard assays. For a review of the families of cytokines, see Mosmann and Coffinan, *Ann. Rev. Immunol.* 7:145–173, 1989.

Preferred adjuvants for use in eliciting a predominantly Th1-type response include, for example, a combination of monophosphoryl lipid A, preferably 3-de-O-acylated monophosphoryl lipid A (3D-MPL), together with an aluminum salt. MPL adjuvants are available from Corixa Corporation (Seattle, Wash.; see U.S. Pat. Nos. 4,436,727; 4,877,611; 4,866,034 and 4,912,094). CpG-containing oligonucleotides (in which the CpG dinucleotide is unmethylated) also induce a predominantly Th1 response. Such oligonucleotides are well known and are described, for example, in WO 96/02555, WO 99/33488 and U.S. Pat. Nos. 6,008,200 and 5,856,462. Immunostimulatory DNA sequences are also described, for example, by Sato et al., *Science* 273:352, 1996. Another preferred adjuvant is a saponin, preferably QS21 (Aquila Biopharmaceuticals Inc., Framingham, Mass.), which may be used alone or in combination with other adjuvants. For example, an enhanced system involves the combination of a monophosphoryl lipid A and saponin derivative, such as the combination of QS21 and 3D-MPL as described in WO 94/00153, or a less reactogenic composition where the QS21 is quenched with cholesterol, as described in WO 96/33739. Other preferred formulations comprise an oil-in-water emulsion and tocopherol. A particularly potent adjuvant formulation involving QS21, 3D-MPL and tocopherol in an oil-in-water emulsion is described in WO 95/17210.

Other preferred adjuvants include Montanide ISA 720 (Seppic, France), SAF (Chiron, Calif., United States), ISCOMS (CSL), MF-59 (Chiron), the SBAS series of adjuvants (e.g., SBAS-2 or SBAS-4, available from SmithKline Beecham, Rixensart, Belgium), Detox (Corixa, Hamilton, Mont.), RC-529 (Corixa, Hamilton, Mont.) and other aminoalkyl glucosaminide 4-phosphates (AGPs), such as those described in pending U.S. patent application Ser. Nos. 08/853,826 and 09/074,720, the disclosures of which are incorporated herein by reference in their entireties.

Any immunogenic composition provided herein may be prepared using well known methods that result in a combination of antigen, immune response enhancer and a suitable carrier or excipient. The compositions described herein may be administered as part of a sustained release formulation (i.e., a formulation such as a capsule, sponge or gel (composed of polysaccharides, for example) that effects a slow release of compound following administration). Such formulations may generally be prepared using well known technology (see, e.g., Coombes et al., *Vaccine* 14:1429–1438, 1996) and administered by, for example, oral, rectal or subcutaneous implantation, or by implantation at the desired target site. Sustained-release formulations may contain a polypeptide, polynucleotide or antibody dispersed in a carrier matrix and/or contained within a reservoir surrounded by a rate controlling membrane.

Carriers for use within such formulations are biocompatible, and may also be biodegradable; preferably the formulation provides a relatively constant level of active component release. Such carriers include microparticles of poly(lactide-co-glycolide), polyacrylate, latex, starch, cellulose, dextran and the like. Other delayed-release carriers include supramolecular biovectors, which comprise a non-liquid hydrophilic core (e.g., a cross-linked polysaccharide or oligosaccharide) and, optionally, an external layer comprising an amphiphilic compound, such as a phospholipid (see e.g., U.S. Pat. No. 5,151,254 and PCT applications WO 94/20078, WO/94/23701 and WO 96/06638). The amount of active compound contained within a sustained release formulation depends upon the site of implantation, the rate and expected duration of release and the nature of the condition to be treated or prevented.

Any of a variety of delivery vehicles may be employed within pharmaceutical compositions and immunogenic compositions to facilitate production of an antigen-specific immune response that targets tumor cells. Delivery vehicles include antigen presenting cells (APCs), such as dendritic cells, macrophages, B cells, monocytes and other cells that may be engineered to be efficient APCs. Such cells may, but need not, be genetically modified to increase the capacity for presenting the antigen, to improve activation and/or maintenance of the T cell response, to have anti-tumor effects per se and/or to be immunologically compatible with the receiver (i.e., matched HLA haplotype). APCs may generally be isolated from any of a variety of biological fluids and organs, including tumor and peritumoral tissues, and may be autologous, allogeneic, syngeneic or xenogeneic cells.

Certain preferred embodiments of the present invention use dendritic cells or progenitors thereof as antigen-presenting cells. Dendritic cells are highly potent APCs (Banchereau and Steinman, Nature 392:245–251, 1998) and have been shown to be effective as a physiological adjuvant for eliciting prophylactic or therapeutic antitumor immunity (see Timmerman and Levy, Ann. Rev. Med. 50:507–529, 1999). In general, dendritic cells may be identified based on their typical shape (stellate in situ, with marked cytoplasmic processes (dendrites) visible in vitro), their ability to take up, process and present antigens with high efficiency and their ability to activate naive T cell responses. Dendritic cells may, of course, be engineered to express specific cell-surface receptors or ligands that are not commonly found on dendritic cells in vivo or ex vivo, and such modified dendritic cells are contemplated by the present invention. As an alternative to dendritic cells, secreted vesicles antigen-loaded dendritic cells (called exosomes) may be used within a vaccine, or immunogenic composition (see Zitvogel et al., Nature Med. 4:594–600, 1998).

Dendritic cells and progenitors may be obtained from peripheral blood, bone marrow, tumor-infiltrating cells, peritumoral tissues-infiltrating cells, lymph nodes, spleen, skin, umbilical cord blood or any other suitable tissue or fluid. For example, dendritic cells may be differentiated ex vivo by adding a combination of cytokines such as GM-CSF, IL-4, IL-13 and/or TNFα to cultures of monocytes harvested from peripheral blood. Alternatively, CD34 positive cells harvested from peripheral blood, umbilical cord blood or bone marrow may be differentiated into dendritic cells by adding to the culture medium combinations of GM-CSF, IL-3, TNFα, CD40 ligand, LPS, flt3 ligand and/or other compound(s) that induce differentiation, maturation and proliferation of dendritic cells.

Dendritic cells are conveniently categorized as "immature" and "mature" cells, which allows a simple way to discriminate between two well characterized phenotypes. However, this nomenclature should not be construed to exclude all possible intermediate stages of differentiation. Immature dendritic cells are characterized as APC with a high capacity for antigen uptake and processing, which correlates with the high expression of Fcγ receptor and mannose receptor. The mature phenotype is typically characterized by a lower expression of these markers, but a high expression of cell surface molecules responsible for T cell activation such as class I and class II MHC, adhesion molecules (e.g., CD54 and CD11) and costimulatory molecules (e.g., CD40, CD80, CD86 and 4-1BB).

APCs may generally be transfected with a polynucleotide encoding a lung tumor protein (or portion or other variant thereof) such that the lung tumor polypeptide, or an immunogenic portion thereof, is expressed on the cell surface. Such transfection may take place ex vivo, and a composition comprising such transfected cells may then be used for therapeutic purposes, as described herein. Alternatively, a gene delivery vehicle that targets a dendritic or other antigen presenting cell may be administered to a patient, resulting in transfection that occurs in vivo. In vivo and ex vivo transfection of dendritic cells, for example, may generally be performed using any methods known in the art, such as those described in WO 97/24447, or the gene gun approach described by Mahvi et al., Immunology and cell Biology 75:456–460, 1997. Antigen loading of dendritic cells may be achieved by incubating dendritic cells or progenitor cells with the lung tumor polypeptide, DNA (naked or within a plasmid vector) or RNA; or with antigen-expressing recombinant bacterium or viruses (e.g., vaccinia, fowlpox, adenovirus or lentivirus vectors). Prior to loading, the polypeptide may be covalently conjugated to an immunological partner that provides T cell help (e.g., a carrier molecule). Alternatively, a dendritic cell may be pulsed with a non-conjugated immunological partner, separately or in the presence of the polypeptide.

Immunogenic compositions and pharmaceutical compositions may be presented in unit-dose or multi-dose containers, such as sealed ampoules or vials. Such containers are preferably hermetically sealed to preserve sterility of the formulation until use. In general, formulations may be stored as suspensions, solutions or emulsions in oily or aqueous vehicles. Alternatively, an immunogenic or pharmaceutical composition may be stored in a freeze-dried condition requiring only the addition of a sterile liquid carrier immediately prior to use.

CANCER THERAPY

In further aspects of the present invention, the compositions described herein may be used for immunotherapy of cancer, such as lung cancer. Within such methods, compositions are typically administered to a patient. As used herein, a "patient" refers to any warm-blooded animal, preferably a human. A patient may or may not be afflicted with cancer. Accordingly, the above pharmaceutical compositions and immunogenic compositions may be used to prevent the development of a cancer or to treat a patient afflicted with a cancer. A cancer may be diagnosed using criteria generally accepted in the art, including the presence of a malignant tumor. Pharmaceutical compositions and immunogenic compositions may be administered either prior to or following surgical removal of primary tumors and/or treatment such as administration of radiotherapy or conventional chemotherapeutic drugs. Administration may be by any suitable method, including administration by intravenous, intraperitoneal, intramuscular, subcutaneous, intranasal, intradennal, anal, vaginal, topical and oral routes.

Within certain embodiments, immunotherapy may be active immunotherapy, in which treatment relies on the in vivo stimulation of the endogenous host immune system to react against tumors with the administration of immune response-modifying agents (such as polypeptides and polynucleotides as provided herein).

Within other embodiments, immunotherapy may be passive immunotherapy, in which treatment involves the delivery of agents with established tumor-immune reactivity (such as effector cells or antibodies) that can directly or indirectly mediate antitumor effects and does not necessarily depend on an intact host immune system. Examples of effector cells include T cells as discussed above, T lymphocytes (such as $CD8^+$ cytotoxic T lymphocytes and $CD4^+$ T-helper tumor-infiltrating lymphocytes), killer cells (such as Natural Killer cells and lymphokine-activated killer cells), B cells and antigen-presenting cells (such as dendritic cells and macrophages) expressing a polypeptide provided herein. T cell receptors and antibody receptors specific for the polypeptides recited herein may be cloned, expressed and transferred into other vectors or effector cells for adoptive immunotherapy. The polypeptides provided herein may also be used to generate antibodies or anti-idiotypic antibodies (as described above and in U.S. Pat. No. 4,918,164) for passive immunotherapy.

Effector cells may generally be obtained in sufficient quantities for adoptive immunotherapy by growth in vitro, as described herein. Culture conditions for expanding single antigen-specific effector cells to several billion in number with retention of antigen recognition in vivo are well known in the art. Such in vitro culture conditions typically use intermittent stimulation with antigen, often in the presence of cytokines (such as IL-2) and non-dividing feeder cells. As noted above, immunoreactive polypeptides as provided herein may be used to rapidly expand antigen-specific T cell cultures in order to generate a sufficient number of cells for immunotherapy. In particular, antigen-presenting cells, such as dendritic, macrophage, monocyte, fibroblast and/or B cells, may be pulsed with immunoreactive polypeptides or transfected with one or more polynucleotides using standard techniques well known in the art. For example, antigen-presenting cells can be transfected with a polynucleotide having a promoter appropriate for increasing expression in a recombinant virus or other expression system. Cultured effector cells for use in therapy must be able to grow and distribute widely, and to survive long term in vivo. Studies have shown that cultured effector cells can be induced to grow in vivo and to survive long term in substantial numbers by repeated stimulation with antigen supplemented with IL-2 (see, for example, Cheever et al., *Immunological Reviews* 157:177, 1997).

Alternatively, a vector expressing a polypeptide recited herein may be introduced into antigen presenting cells taken from a patient and clonally propagated ex vivo for transplant back into the same patient. Transfected cells may be reintroduced into the patient using any means known in the art, preferably in sterile form by intravenous, intracavitary, intraperitoneal or intratumor administration.

Routes and frequency of administration of the therapeutic compositions described herein, as well as dosage, will vary from individual to individual, and may be readily established using standard techniques. In general, the pharmaceutical compositions and immunogenic compositions may be administered by injection (e.g., intracutaneous, intramuscular, intravenous or subcutaneous), intranasally (e.g., by aspiration) or orally. Preferably, between 1 and 10 doses may be administered over a 52 week period. Preferably, 6 doses are administered, at intervals of 1 month, and booster vaccinations may be given periodically thereafter. Alternate protocols may be appropriate for individual patients. A suitable dose is an amount of a compound that, when administered as described above, is capable of promoting an anti-tumor immune response, and is at least 10–50% above the basal (i.e., untreated) level. Such response can be monitored by measuring the anti-tumor antibodies in a patient or by vaccine-dependent generation of cytolytic effector cells capable of killing the patient's tumor cells in vitro. Such vaccines, or immunogenic compositions, should also be capable of causing an immune response that leads to an improved clinical outcome (e.g., more frequent remissions, complete or partial or longer disease-free survival) in vaccinated patients as compared to non-vaccinated patients. In general, for compositions comprising one or more polypeptides, the amount of each polypeptide present in a dose ranges from about 25 μg to 5 mg per kg of host. Suitable dose sizes will vary with the size of the patient, but will typically range from about 0.1 mL to about 5 mL.

In general, an appropriate dosage and treatment regimen provides the active compound(s) in an amount sufficient to provide therapeutic and/or prophylactic benefit. Such a response can be monitored by establishing an improved clinical outcome (e.g., more frequent remissions, complete or partial, or longer disease-free survival) in treated patients as compared to non-treated patients. Increases in preexisting immune responses to a lung tumor protein generally correlate with an improved clinical outcome. Such immune responses may generally be evaluated using standard proliferation, cytotoxicity or cytokine assays, which may be performed using samples obtained from a patient before and after treatment.

CANCER DETECTION AND DIAGNOSIS

In general, a cancer may be detected in a patient based on the presence of one or more lung tumor proteins and/or polynucleotides encoding such proteins in a biological sample (for example, blood, sera, sputum urine and/or tumor biopsies) obtained from the patient. In other words, such proteins may be used as markers to indicate the presence or absence of a cancer such as lung cancer. In addition, such proteins may be useful for the detection of other cancers. The binding agents provided herein generally permit detection of the level of antigen that binds to the agent in the biological sample. Polynucleotide primers and probes may be used to detect the level of mRNA encoding a tumor protein, which is also indicative of the presence or absence of a cancer. In general, a lung tumor sequence should be present at a level that is at least three fold higher in tumor tissue than in normal tissue There are a variety of assay formats known to those of ordinary skill in the art for using a binding agent to detect polypeptide markers in a sample. See, e.g., Harlow and Lane, *Antibodies: A Laboratory Manual,* Cold Spring Harbor Laboratory, 1988. In general, the presence or absence of a cancer in a patient may be determined by (a) contacting a biological sample obtained from a patient with a binding agent; (b) detecting in the sample a level of polypeptide that binds to the binding agent; and (c) comparing the level of polypeptide with a predetermined cut-off value.

In a preferred embodiment, the assay involves the use of binding agent immobilized on a solid support to bind to and remove the polypeptide from the remainder of the sample. The bound polypeptide may then be detected using a detection reagent that contains a reporter group and specifically binds to the binding agent/polypeptide complex. Such detection reagents may comprise, for example, a binding agent that specifically binds to the polypeptide or an antibody or other agent that specifically binds to the binding agent, such as an anti-immunoglobulin, protein G, protein A or a lectin. Alternatively, a competitive assay may be utilized, in which a polypeptide is labeled with a reporter group and allowed to bind to the immobilized binding agent after incubation of the binding agent with the sample. The extent to which components of the sample inhibit the binding of the labeled polypeptide to the binding agent is indicative of the reactivity of the sample with the immobilized binding agent. Suitable polypeptides for use within such assays include full length lung tumor proteins and portions thereof to which the binding agent binds, as described above.

The solid support may be any material known to those of ordinary skill in the art to which the tumor protein may be attached. For example, the solid support may be a test well in a microtiter plate or a nitrocellulose or other suitable membrane. Alternatively, the support may be a bead or disc, such as glass, fiberglass, latex or a plastic material such as polystyrene or polyvinylchloride. The support may also be a magnetic particle or a fiber optic sensor, such as those disclosed, for example, in U.S. Pat. No. 5,359,681. The binding agent may be immobilized on the solid support using a variety of techniques known to those of skill in the art, which are amply described in the patent and scientific literature. In the context of the present invention, the term "immobilization" refers to both noncovalent association, such as adsorption, and covalent attachment (which may be a direct linkage between the agent and functional groups on the support or may be a linkage by way of a cross-linking agent). Immobilization by adsorption to a well in a microtiter plate or to a membrane is preferred. In such cases, adsorption may be achieved by contacting the binding agent, in a suitable buffer, with the solid support for a suitable amount of time. The contact time varies with temperature, but is typically between about 1 hour and about 1 day. In general, contacting a well of a plastic microtiter plate (such as polystyrene or polyvinylchloride) with an amount of binding agent ranging from about 10 ng to about 10 µg, and preferably about 100 ng to about 1 µg, is sufficient to immobilize an adequate amount of binding agent.

Covalent attachment of binding agent to a solid support may generally be achieved by first reacting the support with a bifunctional reagent that will react with both the support and a functional group, such as a hydroxyl or amino group, on the binding agent. For example, the binding agent may be covalently attached to supports having an appropriate polymer coating using benzoquinone or by condensation of an aldehyde group on the support with an amine and an active hydrogen on the binding partner (see, e.g., Pierce Immunotechnology Catalog and Handbook, 1991, at A12-A13).

In certain embodiments, the assay is a two-antibody sandwich assay. This assay may be performed by first contacting an antibody that has been immobilized on a solid support, commonly the well of a microtiter plate, with the sample, such that polypeptides within the sample are allowed to bind to the immobilized antibody. Unbound sample is then removed from the immobilized polypeptide-antibody complexes and a detection reagent (preferably a second antibody capable of binding to a different site on the polypeptide) containing a reporter group is added. The amount of detection reagent that remains bound to the solid support is then determined using a method appropriate for the specific reporter group.

More specifically, once the antibody is immobilized on the support as described above, the remaining protein binding sites on the support are typically blocked. Any suitable blocking agent known to those of ordinary skill in the art, such as bovine serum albumin or Tween 20™ (Sigma Chemical Co., St. Louis, Mo.). The immobilized antibody is then incubated with the sample, and polypeptide is allowed to bind to the antibody. The sample may be diluted with a suitable diluent, such as phosphate-buffered saline (PBS) prior to incubation. In general, an appropriate contact time (i.e., incubation time) is a period of time that is sufficient to detect the presence of polypeptide within a sample obtained from an individual with lung cancer. Preferably, the contact time is sufficient to achieve a level of binding that is at least about 95% of that achieved at equilibrium between bound and unbound polypeptide. Those of ordinary skill in the art will recognize that the time necessary to achieve equilibrium may be readily determined by assaying the level of binding that occurs over a period of time. At room temperature, an incubation time of about 30 minutes is generally sufficient.

Unbound sample may then be removed by washing the solid support with an appropriate buffer, such as PBS containing 0.1% Tween 20™. The second antibody, which contains a reporter group, may then be added to the solid support. Preferred reporter groups include those groups recited above.

The detection reagent is then incubated with the immobilized antibody-polypeptide complex for an amount of time sufficient to detect the bound polypeptide. An appropriate amount of time may generally be determined by assaying the level of binding that occurs over a period of time. Unbound detection reagent is then removed and bound detection reagent is detected using the reporter group. The method employed for detecting the reporter group depends upon the nature of the reporter group. For radioactive groups, scintillation counting or autoradiographic methods are generally appropriate. Spectroscopic methods may be used to detect dyes, luminescent groups and fluorescent groups. Biotin may be detected using avidin, coupled to a different reporter group (commonly a radioactive or fluorescent group or an enzyme). Enzyme reporter groups may generally be detected by the addition of substrate (generally for a specific period of time), followed by spectroscopic or other analysis of the reaction products.

To determine the presence or absence of a cancer, such as lung cancer, the signal detected from the reporter group that remains bound to the solid support is generally compared to a signal that corresponds to a predetermined cut-off value. In one preferred embodiment, the cut-off value for the detection of a cancer is the average mean signal obtained when the immobilized antibody is incubated with samples from patients without the cancer. In general, a sample generating a signal that is three standard deviations above the predetermined cut-off value is considered positive for the cancer. In an alternate preferred embodiment, the cut-off value is determined using a Receiver Operator Curve, according to the method of Sackett et al., *Clinical Epidemiology: A Basic Science for Clinical Medicine,* Little Brown and Co., 1985, p. 106–7. Briefly, in this embodiment, the cut-off value may be determined from a plot of pairs of true positive rates (i.e., sensitivity) and false positive rates (100%-specificity) that correspond to each possible cut-off value for the diagnostic test result. The cut-off value on the plot that is the closest to the upper left-hand corner (i.e., the value that encloses the largest area) is the most accurate cut-off value, and a sample generating a signal that is higher than the cut-off value determined by this method may be considered positive. Alternatively, the cut-off value may be shifted to the left along the plot, to minimize the false positive rate, or to the right, to minimize the false negative rate. In general, a sample generating a signal that is higher than the cut-off value determined by this method is considered positive for a cancer.

In a related embodiment, the assay is performed in a flow-through or strip test format, wherein the binding agent is immobilized on a membrane, such as nitrocellulose. In the flow-through test, polypeptides within the sample bind to the immobilized binding agent as the sample passes through the membrane. A second, labeled binding agent then binds to the binding agent-polypeptide complex as a solution containing the second binding agent flows through the membrane. The detection of bound second binding agent may then be performed as described above. In the strip test format, one end of the membrane to which binding agent is bound is immersed in a solution containing the sample. The sample migrates along the membrane through a region containing second binding agent and to the area of immobilized binding agent. Concentration of second binding agent at the area of immobilized antibody indicates the presence of a cancer. Typically, the concentration of second binding agent at that site generates a pattern, such as a line, that can be read visually. The absence of such a pattern indicates a negative result. In general, the amount of binding agent immobilized on the membrane is selected to generate a visually discernible pattern when the biological sample contains a level of polypeptide that would be sufficient to generate a positive signal in the two-antibody sandwich assay, in the format discussed above. Preferred binding agents for use in such assays are antibodies and antigen-binding fragments thereof. Preferably, the amount of antibody immobilized on the membrane ranges from about 25 ng to about 1 g, and more preferably from about 50 ng to about 500 ng. Such tests can typically be performed with a very small amount of biological sample.

Of course, numerous other assay protocols exist that are suitable for use with the tumor proteins or binding agents of the present invention. The above descriptions are intended to be exemplary only. For example, it will be apparent to those of ordinary skill in the art that the above protocols may be readily modified to use lung tumor polypeptides to detect antibodies that bind to such polypeptides in a biological sample. The detection of such lung tumor protein specific antibodies may correlate with the presence of a cancer.

A cancer may also, or alternatively, be detected based on the presence of T cells that specifically react with a lung tumor protein in a biological sample. Within certain methods, a biological sample comprising $CD4^+$ and/or $CD8^+$ T cells isolated from a patient is incubated with a lung tumor polypeptide, a polynucleotide encoding such a polypeptide and/or an APC that expresses at least an immunogenic portion of such a polypeptide, and the presence or absence of specific activation of the T cells is detected. Suitable biological samples include, but are not limited to, isolated T cells. For example, T cells may be isolated from a patient by routine techniques (such as by Ficoll/Hypaque density gradient centrifugation of peripheral blood lymphocytes). T cells may be incubated in vitro for 2–9 days (typically 4 days) at 37° C. with polypeptide (e.g., 5–25 μg/ml). It may be desirable to incubate another aliquot of a T cell sample in the absence of lung tumor polypeptide to serve as a control. For $CD4^+$ T cells, activation is preferably detected by evaluating proliferation of the T cells. For $CD8^+$ T cells, activation is preferably detected by evaluating cytolytic activity. A level of proliferation that is at least two fold greater and/or a level of cytolytic activity that is at least 20% greater than in disease-free patients indicates the presence of a cancer in the patient.

As noted above, a cancer may also, or alternatively, be detected based on the level of mRNA encoding a lung tumor protein in a biological sample. For example, at least two oligonucleotide primers may be employed in a polymerase chain reaction (PCR) based assay to amplify a portion of a lung tumor cDNA derived from a biological sample, wherein at least one of the oligonucleotide primers is specific for (i.e., hybridizes to) a polynucleotide encoding the lung tumor protein. The amplified cDNA is then separated and detected using techniques well known in the art, such as gel electrophoresis. Similarly, oligonucleotide probes that specifically hybridize to a polynucleotide encoding a lung tumor protein may be used in a hybridization assay to detect the presence of polynucleotide encoding the tumor protein in a biological sample.

To permit hybridization under assay conditions, oligonucleotide primers and probes should comprise an oligonucleotide sequence that has at least about 60%, preferably at least about 75% and more preferably at least about 90%, identity to a portion of a polynucleotide encoding a lung tumor protein that is at least 10 nucleotides, and preferably at least 20 nucleotides, in length. Preferably, oligonucleotide primers and/or probes hybridize to a polynucleotide encoding a polypeptide described herein under moderately stringent conditions, as defined above. Oligonucleotide primers and/or probes which may be usefully employed in the diagnostic methods described herein preferably are at least 10–40 nucleotides in length. In a preferred embodiment, the oligonucleotide primers comprise at least 10 contiguous nucleotides, more preferably at least 15 contiguous nucleotides, of a DNA molecule having a sequence recited herein. Techniques for both PCR based assays and hybridization assays are well known in the art (see, for example, Mullis et al., *Cold Spring Harbor Symp. Quant. Biol.,* 51:263, 1987; Erlich ed., *PCR Technology,* Stockton Press, N.Y., 1989).

One preferred assay employs RT-PCR, in which PCR is applied in conjunction with reverse transcription. Typically, RNA is extracted from a biological sample, such as biopsy tissue, and is reverse transcribed to produce cDNA molecules. PCR amplification using at least one specific primer generates a cDNA molecule, which may be separated and visualized using, for example, gel electrophoresis. Amplification may be performed on biological samples taken from a test patient and from an individual who is not afflicted with a cancer. The amplification reaction may be performed on several dilutions of cDNA spanning two orders of magnitude. A two-fold or greater increase in expression in several dilutions of the test patient sample as compared to the same dilutions of the non-cancerous sample is typically considered positive.

In another embodiment, the compositions described herein may be used as markers for the progression of cancer. In this embodiment, assays as described above for the diagnosis of a cancer may be performed over time, and the change in the level of reactive polypeptide(s) or polynucleotide(s) evaluated. For example, the assays may be performed every 24–72 hours for a period of 6 months to 1 year, and thereafter performed as needed. In general, a cancer is progressing in those patients in whom the level of polypeptide or polynucleotide detected increases over time. In contrast, the cancer is not progressing when the level of reactive polypeptide or polynucleotide either remains constant or decreases with time.

Certain in vivo diagnostic assays may be performed directly on a tumor. One such assay involves contacting tumor cells with a binding agent. The bound binding agent may then be detected directly or indirectly via a reporter group. Such binding agents may also be used in histological applications. Alternatively, polynucleotide probes may be used within such applications.

As noted above, to improve sensitivity, multiple lung tumor protein markers may be assayed within a given sample. It will be apparent that binding agents specific for different proteins provided herein may be combined within a single assay. Further, multiple primers or probes may be used concurrently. The selection of tumor protein markers may be based on routine experiments to determine combinations that results in optimal sensitivity. In addition, or alternatively, assays for tumor proteins provided herein may be combined with assays for other known tumor antigens.

DIAGNOSTIC KITS

The present invention further provides kits for use within any of the above diagnostic methods. Such kits typically comprise two or more components necessary for performing a diagnostic assay. Components may be compounds, reagents, containers and/or equipment. For example, one container within a kit may contain a monoclonal antibody or fragment thereof that specifically binds to a lung tumor protein. Such antibodies or fragments may be provided attached to a support material, as described above. One or more additional containers may enclose elements, such as reagents or buffers, to be used in the assay. Such kits may also, or alternatively, contain a detection reagent as described above that contains a reporter group suitable for direct or indirect detection of antibody binding.

Alternatively, a kit may be designed to detect the level of mRNA encoding a lung tumor protein in a biological sample. Such kits generally comprise at least one oligonucleotide probe or primer, as described above, that hybridizes to a polynucleotide encoding a lung tumor protein. Such an oligonucleotide may be used, for example, within a PCR or hybridization assay. Additional components that may be present within such kits include a second oligonucleotide and/or a diagnostic reagent or container to facilitate the detection of a polynucleotide encoding a lung tumor protein.

The following Examples are offered by way of illustration and not by way of limitation.

EXAMPLE 1

IDENTIFICATION AND CHARACTERIZATION OF LUNG TUMOR PROTEIN cDNAS

This Example illustrates the identification of cDNA molecules encoding lung tumor proteins.

A. Isolation of cDNA Sequences from Lung Adenocarcinoma Libraries using Conventional cDNA Library Subtraction A human lung adenocarcinoma cDNA expression library was constructed from poly A+ RNA from patient tissues (# 40031486) using a Superscript Plasmid System for cDNA Synthesis and Plasmid Cloning kit (BRL Life Technologies, Gaithersburg, Md.) following the manufacturer's protocol. Specifically, lung carcinoma tissues were homogenized with polytron (Kinematica, Switzerland) and total RNA was extracted using Trizol reagent (BRL Life Technologies) as directed by the manufacturer. The poly A+ RNA was then purified using an oligo dT cellulose column as described in Sambrook et al., *Molecular Cloning: A Laboratory Manual*, Cold Spring Harbor Laboratories, Cold Spring Harbor, N.Y., 1989. First-strand cDNA was synthesized using the NotI/Oligo-dT18 primer. Double-stranded cDNA was synthesized, ligated with BstXI/EcoRI adaptors (Invitrogen, San Diego, Calif.) and digested with NotI. Following size fractionation with cDNA size fractionation columns (BRL Life Technologies), the cDNA was ligated into the BstXI/NotI site of pcDNA3.1 (Invitrogen) and transformed into ElectroMax *E. coli* DH10B cells (BRL Life Technologies) by electroporation. A total of $3 \times 10^6$ independent colonies were generated.

Using the same procedure, a normal human cDNA expression library was prepared from a panel of normal tissue specimens, including lung, liver, pancreas, skin, kidney, brain and resting PBMC.

cDNA library subtraction was performed using the above lung adenocarcinoma and normal tissue cDNA libraries, as described by Hara et al. (*Blood*, 84:189–199, 1994) with some modifications. Specifically, a lung adenocarcinoma-specific subtracted cDNA library was generated as follows. The normal tissue cDNA library (80 µg) was digested with BamHI and XhoI, followed by a filling-in reaction with DNA polymerase Klenow fragment. After phenol-chloroform extraction and ethanol precipitation, the DNA was dissolved in 133 µl of $H_2O$, heat-denatured and mixed with 133 µl (133 µg) of Photoprobe biotin (Vector Laboratories, Burlingame, Calif.). As recommended by the manufacturer, the resulting mixture was irradiated with a 270 W sunlamp on ice for 20 minutes. Additional Photoprobe biotin (67 µl) was added and the biotinylation reaction was repeated. After extraction with butanol five times, the DNA was ethanol-precipitated and dissolved in 23 µl $H_2O$. The resulting DNA, plus other highly redundant cDNA clones that were frequently recovered in previous lung subtractions formed the driver DNA.

To form the tracer DNA, 10 µg lung adenocarcinoma cDNA library was digested with NotI and SpeI, phenol chloroform extracted and passed through Chroma spin-400 columns (Clontech, Palo Alto, Calif.). Typically, 5 µg of cDNA was recovered after the sizing column. Following ethanol precipitation, the tracer DNA was dissolved in 5 µl $H_2O$. Tracer DNA was mixed with 15 µl driver DNA and 20 µl of 2×hybridization buffer (1.5 M NaCl/10 mM EDTA/50 mM HEPES pH 7.5/0.2% sodium dodecyl sulfate), overlaid with mineral oil, and heat-denatured completely. The sample was immediately transferred into a 68° C. water bath and incubated for 20 hours (long hybridization [LH]). The reaction mixture was then subjected to a streptavidin treatment followed by phenol/chloroform extraction. This process was repeated three more times. Subtracted DNA was precipitated, dissolved in 12 µl $H_2O$, mixed with 8 µl driver DNA and 20 µl of 2×hybridization buffer, and subjected to a hybridization at 68° C. for 2 hours (short hybridization [SH]). After removal of biotinylated double-stranded DNA, subtracted cDNA was ligated into NotI/SpeI site of chloramphenicol resistant pBCSK+ (Stratagene, La Jolla, Calif.) and transformed into ElectroMax *E. Coli* DH10B cells by electroporation to generate a lung adenocarcinoma specific subtracted cDNA library, referred to as LAT-S1 Similarly, LAT-S2 was generated by including 23 genes that were over-expressed in the tracer as additional drivers.

A second human lung adenocarcinoma cDNA expression library was constructed using adenocarcinoma tissue from a second patient (# 86–66) and used to prepare a second lung adenocarcinoma-specific subtracted cDNA library (referred to as LAT2-S2), as described above, using the same panel of normal tissues and the additional genes over-expressed in LAT-S1.

A third human metastatic lung adenocarcinoma library was constructed from a pool of two lung pleural effusions with lung and gastric adenocarcinoma origins. The subtracted cDNA library, Mets-sub2 was generated as described above using the same panel of normal tissues. However, the Mets-sub3 subtracted library was constructed by including 51 additional genes as drivers. These 51 genes were recovered in Mets-sub2, representing over-expressed housekeeping genes in the testers. As a result, Mets-sub3 is more complexed and normalized.

A total of 16 cDNA fragments isolated from LAT-S1, 585 cDNA fragments isolated from LAT-S2, 568 cDNA clones from LAT2-S2, 15 cDNA clones from Mets-sub2 and 343 cDNA clones from Mets-sub3, described above, were colony PCR amplified and their mRNA expression levels in lung tumor, normal lung, and various other normal and tumor tissues were determined using microarray technology (Incyte, Palo Alto, Calif.). Briefly, the PCR amplification products were dotted onto slides in an array format, with each product occupying a unique location in the array. mRNA was extracted from the tissue sample to be tested, reverse transcribed, and fluorescent-labeled cDNA probes were generated. The microarrays were probed with the labeled cDNA probes, the slides scanned and fluorescence intensity was measured. This intensity correlates with the hybridization intensity. Seventy-three non-redundant cDNA clones, of which 42 were found to be unique, showed over-expression in lung tumors, with expression in normal tissues tested (lung, skin, lymph node, colon, liver, pancreas, breast, heart, bone marrow, large intestine, kidney, stomach, brain, small intestine, bladder and salivary gland) being either undetectable, or at significantly lower levels compared to lung adenocarcinoma tumors. These clones were further characterized by DNA sequencing with a Perkin Elmer/Applied Biosystems Division Automated Sequencer Model 373A and/or Model 377 (Foster City, Calif.).

The sequences were compared to known sequences in the gene bank using the EMBL GenBank databases (release 96). No significant homologies were found to the sequence provided in SEQ ID NO: 67, with no apparent homology to previously identified expressed sequence tags (ESTs). The sequences of SEQ ID NO: 60, 62, 65, 66, 69–71, 74, 76, 79, 80, 84, 86, 89–92, 95, 97 and 98 were found to show some homology to previously identified expressed sequence tags (ESTs). The cDNA sequences of SEQ ID NO: 59, 61, 63, 64, 67, 68, 72, 73, 75, 77, 78, 81–83, 85, 87, 88, 93, 94, 96, 99 and 100 showed homology to previously identified genes. The full-length cDNA sequences for the clones of SEQ ID NO: 96 and 100 are provided in SEQ ID NO: 316 and 318, respectively. The amino acid sequences for the clones of SEQ ID NO: 59, 61, 63, 64, 68, 73, 82, 83, 94, 96 and 100 are provided in SEQ ID NO: 331, 328, 329, 332, 327, 333, 330, 326, 325, 324 and 335, respectively. A predicted amino acid sequence encoded by the sequence of SEQ ID NO: 69 (referred to as L552S) is provided in SEQ ID NO: 786.

Further studies led to the isolation of an extended cDNA sequence, and open reading frame, for L552S (SEQ ID NO: 790). The predicted amino acid sequence encoded by the cDNA sequence of SEQ ID NO: 790 is provided in SEQ ID NO: 791. The determined cDNA sequence of an isoform of L552S is provided in SEQ ID NO: 792, with the corresponding predicted amino acid sequence being provided in SEQ ID NO: 793. Subsequent studies led to the isolation of the full-length cDNA sequence of L552S (SEQ ID NO: 808). The corresponding amino acid sequence is provided in SEQ ID NO: 809. No homologies were found to the protein sequence of L552S. However, nucleotides 533–769 of the full-length cDNA sequence were found to show homology to a previously identified DNA sequence.

Full-length cloning efforts on L552S led to the isolation of three additional cDNA sequences (SEQ ID NO: 810–812) from a metastatic lung adenocarcinoma library. The sequence of SEQ ID NO: 810 was found to show some homology to previously identified human DNA sequences. The sequence of SEQ ID NO: 811 was found to show some homology to a previously identified DNA sequence. The sequence of SEQ ID NO: 812 was found to show some homology to previously identified ESTs.

The gene of SEQ ID NO: 84 (referred to as L551S) was determined by real-time RT-PCR analysis to be over-expressed in 2/9 primary adenocarcinomas and to be expressed at lower levels in 2/2 metastatic adenocarcinomas and 1/2 squamous cell carcinomas. No expression was observed in normal tissues, with the exception of very low expression in normal stomach. Further studies on L551S led to the isolation of the 5' and 3' cDNA consensus sequences provided in SEQ ID NO: 801 and 802, respectively. The L551S 5' sequence was found to show some homology to the previously identified gene STY8 (cDNA sequence provided in SEQ ID NO: 803; corresponding amino acid sequence provided in SEQ ID NO: 805), which is a mitogen activated protein kinase phosphatase. However, no significant homologies were found to the 3' sequence of L551S. Subsequently, an extended cDNA sequence for L551S was isolated (SEQ ID NO: 804). The corresponding amino acid sequence is provided in SEQ ID NO: 806. Further studies led to the isolation of two independent full-length clones for L551S (referred to as 54298 and 54305). These two clones have five nucleotide differences compared to the STY8 DNA sequence. Two of these differences are single nucleotide polymorphisms which do not effect the encoded amino acid sequences. The other three nucleotide differences are consistent between the two L551S clones but lead to encoded amino acid sequences that are different from the STY8 protein sequence. The determined cDNA sequences for the L551S full-length clones 54305 and 54298 are provided in SEQ ID NO: 825 and 826, respectively, with the amino acid sequence for L551S being provided in SEQ ID NO: 827.

B. Isolation of cDNA Sequences from Lung Adenocarcinoma Libraries using PCR-Based cDNA Library Subtraction cDNA clones from a PCR-based subtraction library, containing cDNA from a pool of two human lung primary adenocarcinomas subtracted against a pool of nine normal human tissue cDNAs including skin, colon, lung, esophagus, brain, kidney, spleen, pancreas and liver, (Clontech, Palo Alto, Calif.) were derived and submitted to a first round of PCR amplification. This library (referred to as ALT-1) was subjected to a second round of PCR amplification, following the manufacturer's protocol. The expression levels of 760 cDNA clones in lung tumor, normal lung, and various other normal and tumor tissues, were examined using microarray technology as described above. A total of 118 clones, of which 55 were unique, were found to be over-expressed in lung tumor tissue, with expression in normal tissues tested (lung, skin, lymph node, colon, liver, pancreas, breast, heart, bone marrow, large intestine, kidney, stomach, brain, small intestine, bladder and salivary gland) being either undetectable, or at significantly lower levels. The sequences were compared to known sequences in the gene bank using the EMBL and GenBank databases (release 96). No significant homologies (including ESTs) were found to the sequence provided in SEQ ID NO: 44. The sequences of SEQ ID NO: 1, 11, 13, 15, 20, 23–27, 29, 30, 33, 34, 39, 41, 43, 45, 46, 51 and 57 were found to show some homology to previously identified expressed sequence tags (ESTs). The cDNA sequences of SEQ ID NO: 2–10, 12, 14, 16–19, 21, 22, 28, 31, 32, 35–38, 40, 42, 44, 47–50, 52–56 and 58 showed homology to previously identified genes. The full-length cDNA sequences for the clones of SEQ ID NO: 18, 22, 31, 35, 36 and 42 are provided in SEQ ID NO: 320, 319, 323, 321, 317, 321 and 322, respectively, with the corresponding amino acid sequences being provided in SEQ ID NO: 337, 336, 340, 338, 334, and 339, respectively.

Further studies led to the isolation of an extended cDNA sequence for the clone of SEQ ID NO: 33 (referred to as L801P). This extended cDNA sequence (provided in SEQ ID NO: 796), was found to contain three potential open reading frames (ORFs). The predicted amino acid sequences encoded by these three ORFs are provided in SEQ ID NO: 797–799, respectively. Additional full-length cloning efforts led to still further extended cDNA sequence for L801P, set forth in SEQ ID NO:1669, in addition to five potential open reading frames (ORFs 4–9; SEQ ID NOs: 1670–1675, respectively) encoded by the extended cDNA sequence. Moreover, L801P was mapped to chromosomal region 20p13 and a 137 amino acid ORF from this genomic region was identified that corresponds to ORF4 (SEQ ID NO: 1670), suggesting that this is likely an authentic ORF for L801P.

By microarray analysis, L801P was overexpressed by 2-fold or greater in the lung tumor probe groups compared to the normal tissue probe group (not shown). By real-time PCR analysis, greater than 50% of lung adenocarcinoma and greater than 30% of lung squamous cell carcinoma tumor samples tested had elevated L801P expression relative to normal lung tissue. Of those that displayed elevated L801P, the level of expression was greater than 10-fold higher than in normal lung tissue samples. Moreover, low or no expression of L801P was detected in an extensive panel of normal tissue RNAs.

We have also found that L801P expression is detected in a number of other tumor types, including breast, prostate, ovarian and colon tumors, and thus may have diagnostic and/or therapeutic utility in these cancer types as well.

In subsequent studies, a full-length cDNA sequence for the clone of SEQ ID NO: 44 (referred to as L844P) was isolated (provided in SEQ ID NO: 800). Comparison of this sequence with those in the public databases revealed that the 470 bases at the 5' end of the sequence show homology to the known gene dihydrodiol dehydrogenase, thus indicating that L844P is a novel transcript of the dihydrodiol dehydrogenase family having 2007 base pairs of previously unidentified 3' untranslated region.

The predicted amino acid sequence encoded by the sequence of SEQ ID NO: 46 (referred to as L840P) is provided in SEQ ID NO: 787. An extended cDNA sequence for L840P, which was determined to include an open reading frame, is provided in SEQ ID NO: 794. The predicted amino acid sequence encoded by the cDNA sequence of SEQ ID NO: 794 is provided in SEQ ID NO: 795. The full-length cDNA sequence for the clone of SEQ ID NO: 54 (referred to as L548S) is provided in SEQ ID NO: 788, with the corresponding amino acid sequence being provided in SEQ ID NO: 789.

Northern blot analyses of the genes of SEQ ID NO: 25 and 46 (referred to as L839P and L840P, respectively) were remarkably similar. Both genes were expressed in 1/2 lung adenocarcinomas as two bands of 3.6 kb and 1.6 kb. No expression of L839P was observed in normal lung or trachea. No expression of L840P was observed in normal bone marrow, resting or activated PBMC, esophagus, or normal lung. Given the similar expression patterns, L839P and L840P may be derived from the same gene.

Further studies on L773P (SEQ ID NO: 58) resulted in the isolation of the extended consensus cDNA sequence provided in SEQ ID NO: 807.

Additional lung adenocarcinoma cDNA clones were isolated as follows. A cDNA library was prepared from a pool of two lung adenocarcinomas and subtracted against cDNA from a panel of normal tissues including lung, brain, liver, kidney, pancreas, skin, heart and spleen. The subtraction was performed using a PCR-based protocol (Clontech), which was modified to generate larger fragments. Within this protocol, tester and driver double stranded cDNA were separately digested with five restriction enzymes that recognize six-nucleotide restriction sites (MluI, MscI, PvuII, SalI and StuI). This digestion resulted in an average cDNA size of 600 bp, rather than the average size of 300 bp that results from digestion with RsaI according to the Clontech protocol. The ends of the restriction digested tester cDNA were filled in to generate blunt ends for adapter ligation. This modification did not affect the subtraction efficiency. Two tester populations were then created with different adapters, and the driver library remained without adapters. The tester and driver libraries were then hybridized using excess driver cDNA. In the first hybridization step, driver was separately hybridized with each of the two tester cDNA populations. This resulted in populations of (a) unhybridized tester cDNAs, (b) tester cDNAs hybridized to other tester cDNAs, (c) tester cDNAs hybridized to driver cDNAs and (d) unhybridized driver cDNAs. The two separate hybridization reactions were then combined, and rehybridized in the presence of additional denatured driver cDNA. Following this second hybridization, in addition to populations (a) through (d), a fifth population (e) was generated in which tester cDNA with one adapter hybridized to tester cDNA with the second adapter. Accordingly, the second hybridization step resulted in enrichment of differentially expressed sequences which could be used as templates for PCR amplification with adaptor-specific primers.

The ends were then filled in, and PCR amplification was performed using adaptor-specific primers. Only population (e), which contained tester cDNA that did not hybridize to driver cDNA, was amplified exponentially. A second PCR amplification step was then performed, to reduce background and further enrich differentially expressed sequences.

Fifty-seven cDNA clones were isolated from the subtracted library (referred to as LAP1) and sequenced. The determined cDNA sequences for 16 of these clones are provided in SEQ ID NO: 101–116. The sequences of SEQ ID NO: 101 and 114 showed no significant homologies to previously identified sequences. The sequences of SEQ ID NO: 102–109 and 112 showed some similarity to previously identified sequences, while the sequences of SEQ ID NO: 113, 115 and 116 showed some similarity to previously isolated ESTs.

An additional 502 clones analyzed from the LAP1 library were sequenced and the determined cDNA sequences are shown in SEQ ID NO:828–1239 and 1564–1653.

C. Isolation of cDNA Sequences from Small Cell Lung Carcinoma Libraries using PCR-Based cDNA Library Subtraction A subtracted cDNA library for small cell lung carcinoma (referred to as SCL1) was prepared using essentially the modified PCR-based subtraction process described above. cDNA from small cell lung carcinoma was subtracted against cDNA from a panel of normal tissues, including normal lung, brain, kidney, liver, pancreas, skin, heart, lymph node and spleen. Both tester and driver poly A+ RNA were initially amplified using SMART PCR cDNA synthesis kit (Clontech, Palo Alto, Calif.). The tester and driver double stranded cDNA were separately digested with five restriction enzymes (DraI, MscI, PvuII, SmaI, and StuI). These restriction enzymes generated blunt end cuts and the digestion resulted in an average insert size of 600 bp. Digestion with this set of restriction enzymes eliminates the step required to generate blunt ends by filling in of the cDNA ends. These modifications did not affect subtraction efficiency.

Eighty-five clones were isolated and sequenced. The determined cDNA sequences for 31 of these clones are provided in SEQ ID NO: 117–147. The sequences of SEQ ID NO: 122, 124, 126, 127, 130, 131, 133, 136, 139 and 147 showed no significant homologies to previously identified sequences. The sequences of SEQ ID NO: 120, 129, 135, 137, 140, 142, 144 and 145 showed some similarity to previously identified gene sequences, while the sequences of SEQ ID NO: 114, 118, 119, 121, 123, 125, 128, 132, 134, 138, 141, 143 and 147 showed some similarity to previously isolated ESTs.

In further studies, three additional cDNA libraries were generated from poly A+ RNA from a single small cell lung carcinoma sample subtracted against a pool of poly A+ RNA from nine normal tissues (lung, brain, kidney, liver, pancreas, skin, heart pituitary gland and spleen). For the first library (referred to as SCL2), the subtraction was carried out essentially as described above for the LAP1 library, with the exception that the tester and driver were digested with PvuII, StuI, MscI and DraI. The ratio of tester and driver cDNA used was as recommended by Clontech. For the second library (referred to as SCL3), subtraction was performed essentially as for SCL2 except that cDNA for highly redundant clones identified from the SCL2 library was included in the driver cDNA. Construction of the SCL4 library was performed essentially as described for the SCL3 library except that a higher ratio of driver to tester was employed.

Each library was characterized by DNA sequencing and database analyses. The determined cDNA sequence for 35 clones isolated from the SCL2 library are provided in SEQ ID NO: 245–279, with the determined cDNA sequences for 21 clones isolated from the SCL3 library and for 15 clones isolated from the SCL4 library being provided in SEQ ID NO: 280–300 and 301–315, respectively. The sequences of SEQ ID NO: 246, 254, 261, 262, 304, 309 and 311 showed no significant homologies to previously identified sequences. The sequence of SEQ ID NO: 245, 248, 255, 266, 270, 275, 280, 282, 283, 288–290, 292, 295, 301 and 303 showed some homology to previously isolated ESTs, while the sequences of SEQ ID NO: 247, 249–253, 256–260, 263–265, 267–269, 271–274, 276–279, 281, 284–287, 291, 293, 294, 296–300, 302, 305–308, 310 and 312–315 showed some homology to previously identified gene sequences.

3264 cDNA clones from three PCR-based subtracted cDNA libraries were analyzed by cDNA microarray technology as part of Lung Chip 5. Of the 3264 cDNA clones 960 clones came from SQL1 library, 768 clones came from SCL1 library, and 1536 clones came from SCL3 and SCL4 libraries. 35 pairs of fluorescent labeled cDNA probes were used for the microarray analysis. Each probe pair included a lung tumor probe paired with a normal tissue probe. The expression data was analyzed. 498 cDNA clones were found to be overexpressed by 2-fold or greater in the small cell and/or non-small cell lung tumor probe groups compared to the normal tissue probe group. Also, the mean expression values for these clones in normal tissues were below 0.1 (range of expression is from 0.001 to 10). The cDNA sequences disclosed in SEQ ID NO:1240–1563 represent 324 non-redundant clones.

The following sequences were novel based on database analysis including GenBank and GeneSeq: SEQ ID NO:1240, 1243, 1247, 1269, 1272, 1280, 1283, 1285, 1286, 1289, 1300, 1309, 1318, 1319, 1327, 1335, 1339, 1346, 1359, 1369, 1370, 1371, 1393, 1398, 1405, 1408, 1413, 1414, 1417, 1422, 1429, 1432, 1435, 1436, 1438–1442, 1447, 1450, 1453, 1463, 1467, 1470, 1473, 1475, 1482, 1486, 1491–1494, 1501, 1505, 1506, 1514–1517, 1520, 1522, 1524, 1535, 1538, 1542, 1543, 1547, 1554, 1557, 1559, 1561, and 1563.

Full-length sequence for contig 139 (SEQ ID NO: 1467), also known as L985P, was identified by searching public databases using SEQ ID NO: 1467 as a query. By this approach, L985 was identified as cell surface immunomodulator-2 (CSIMM-2), the cDNA sequence of which is set forth in SEQ ID NO: 1676, encoding a protein having the sequence set forth in SEQ ID NO: 1677.

By microarray analysis, L985P was overexpressed by 2-fold or greater in the lung tumor probe groups compared to the normal tissue probe group. Moreover, the mean expression values for L985P in normal tissues was below 0.2 (range of expression was from 0.01 to 10). By real-time PCR analysis, greater than 40% of small cell lung carcinoma lung tumor samples tested had elevated L985P expression relative to normal lung tissue. Of those that displayed elevated L985P, the level of expression was greater than 3-fold higher than in normal lung tissue samples. Low or no expression of L985P was detected in an extensive panel of normal tissue RNAs. These findings for L985P support its use both as a diagnositic marker for detecting the presence of lung cancer in a patient and/or as a immunotherapeutic target for the treatment of lung cancer.

D. Isolation of cDNA Sequences from a Neuroendocrine Library using PCR-Based cDNA Library Subtraction Using the modified PCR-based subtraction process, essentially as described above for the LAP1 subtracted library, a subtracted cDNA library (referred to as MLN1) was derived from a lung neuroendocrine carcinoma that had metastasized to the subcarinal lymph node, by subtraction with a panel of nine normal tissues, including normal lung, brain, kidney, liver, pancreas, skin, heart, lymph node and spleen.

Ninety-one individual clones were isolated and sequenced. The determined cDNA sequences for 58 of these clones are provided in SEQ ID NO: 147–222. The sequences of SEQ ID NO: 150, 151, 154, 157, 158, 159, 160, 163, 174, 175, 178, 186–190, 192, 193, 195–200, 208–210, 212–215 and 220 showed no significant homologies to previously identified sequences. The sequences of SEQ ID NO: 152, 155, 156, 161, 165, 166, 176, 179, 182, 184, 185, 191, 194, 221 and 222 showed some similarity to previously identified gene sequences, while the sequences of SEQ ID NO: 148, 149, 153, 164, 167–173, 177, 180, 181, 183, 201–207, 211 and 216–219 showed some similarity to previously isolated ESTs.

The determined cDNA sequences of an additional 442 clones isolated from the MLN1 library are provided in SEQ ID NO: 341–782. The determined cDNA sequences of an additional 11 clones isolated from the MLN1 library are provided in SEQ ID NO:1654–1664.

E. Isolation of cDNA Sequences from a Squamous Cell Lung Carcinoma Library using PCR-Based cDNA Library Subtraction A subtracted cDNA library for squamous cell lung carcinoma (referred to as SQL1) was prepared, essentially using the modified PCR-based subtraction process described above, except the tester and driver double stranded cDNA were separately digested with four restriction enzymes (DraI, MscI, PvuII and StuI) cDNA from a pool of two squamous cell lung carcinomas was subtracted against cDNA from a pool of 10 normal tissues, including normal lung, brain, kidney, liver, pancreas, skin, heart, spleen, esophagus and trachea.

Seventy-four clones were isolated and sequenced. The determined cDNA sequences for 22 of these clones are provided in SEQ ID NO: 223–244. The sequence of SEQ ID NO: 241 showed no significant homologies to previously identified sequences. The sequences of SEQ ID NO: 223, 225, 232, 233, 235, 238, 239, 242 and 243 showed some similarity to previously identified gene sequences, while the sequences of SEQ ID NO: 224, 226–231, 234, 236, 237, 240, 241 and 244 showed some similarity to previously isolated ESTs.

The sequences of an additional 12 clones isolated during characterization of cDNA libraries prepared from lung tumor tissue are provided in SEQ ID NO: 813–824. Comparison of these sequences with those in the GenBank database and the GeneSeq DNA database revealed no significant homologies to previously identified sequences.

EXAMPLE 2

SYNTHESIS OF POLYPEPTIDES

Polypeptides may be synthesized on a Perkin Elmer/ Applied Biosystems Division 430A peptide synthesizer using FMOC chemistry with HPTU (O-Benzotriazole-N,N, N',N'-tetramethyluronium hexafluorophosphate) activation. A Gly-Cys-Gly sequence may be attached to the amino terminus of the peptide to provide a method of conjugation, binding to an immobilized surface, or labeling of the peptide. Cleavage of the peptides from the solid support may be carried out using the following cleavage mixture: trifluoroacetic acid:ethanedithiol:thioanisole:water:phenol (40:1:2:2:3). After cleaving for 2 hours, the peptides may be precipitated in cold methyl-t-butyl-ether. The peptide pellets may then be dissolved in water containing 0.1% trifluoroacetic acid (TFA) and lyophilized prior to purification by C18 reverse phase HPLC. A gradient of 0%–60% acetonitrile (containing 0.1% TFA) in water (containing 0.1% TFA) may be used to elute the peptides. Following lyophilization of the pure fractions, the peptides may be characterized using electrospray or other types of mass spectrometry and by amino acid analysis.

EXAMPLE 3

PREPARATION OF ANTIBODIES AGAINST LUNG CANCER ANTIGENS

Polyclonal antibodies against the lung cancer antigen L773P (SEQ ID NO: 783) were prepared as follows.

Rabbits were immunized with recombinant protein expressed in and purified from *E. Coli* as described above. For the initial immunization, 400 µg of antigen combined with muramyl dipeptide (MDP) was injected subcutaneously (S.C.). Animals were boosted S.C. 4 weeks later with 200 µg of antigen mixed with incomplete Freund's Adjuvant (IFA). Subsequent boosts of 100 µg of antigen mixed with IFA were injected S.C. as necessary to induce high antibody titer responses. Serun bleeds from immunized rabbits were tested for L773P-specific reactivity using ELISA assays with purified protein and showed strong reactivity to L733P. Polyclonal antibodies against L773P were affinity purified from high titer polyclonal sera using purified protein attached to a solid support.

EXAMPLE 4

PROTEIN EXPRESSION OF LUNG TUMOR-SPECIFIC ANTIGENS

Full-length L773P (amino acids 2–364 of SEQ ID NO: 783), with a 6× His Tag, were subcloned into the pPDM expression vector and transformed into either BL21 Codon-Plus or BL21 pLysS host cells using standard techniques. High levels of expression were observed in both cases. Similarly, the N-terminal portion of L773P (amino acids 2–71 of SEQ ID NO: 783; referred to as L773PA), with a 6× His tag were subcloned into the vector pPDM and transformed into BL21 CodonPlus host cells. Low levels of expression were observed by N-terminal sequencing. The sequence of the expressed constructs for L773P and L773PA are provided in SEQ ID NO: 784 and 785, respectively.

EXAMPLE 5

EXPRESSION IN *E. COLI* OF L548S HIS TAG FUSION PROTEIN

The L548S coding region was PCR amnplified with the following primers:

Forward primer starting at amino acid 2:

PDM-433: 5' gctaaaggtgaccccaagaaaccaaag 3' Tm 60° C. (SEQ ID NO:1665)

Reverse primer creating a XhoI site after the stop codon:

PDM-438: 5' ctattaactcgagggagacagataaacagtttcttta 3' Tm 6° C. (SEQ ID NO:1666)

The PCR product was then digested with XhoI restriction enzyme, gel purified and then cloned into pPDM His, a modified pET28 vector with a His tag in frame, which had been digested with Eco72I and XhoI restriction enzymes. The correct construct was confirmed by DNA sequence analysis and then transformned into BL21 (DE3) pLys S and BL21 (DE3) CodonPlus RIL expression hosts.

The protein sequence of expressed recombinant L548S is shown in SEQ ID NO:1667, and the DNA sequence of expressed recombinant L7548S is shown in SEQ ID NO: 1668.

EXAMPLE 6

ADDITIONAL ANALYSES OF LUNG CHIP 5 SQL1, SCL1, SCL3 AND SCL4 LIBRARIES

Additional analyses were performed on lung chip 5 using a criteria of greater than or equal to 2-fold over-expression in tumor probe groups versus normnal tissues and an average expression in normal tissues of less than or equal to 0.2. This resulted in the identification of 109 non-redundant clones that are over-expressed in lung carcinomas. As summarized in the table below, 19 cDNA clones were recovered from the lung squamous cell carcinoma subtracted library SQL1, 9 cDNA clones were recovered from the small cell lung carcinoma library SCL1 and 81 cDNA clones were recovered from the small cell lung carcinoma libraries SCL3 and SCL4.

| SEQ ID NO: | Seq. Ref. | Element (384) | Element (96) | Ratio | Mean Signal 1 | Mean Signal 2 | Library |
|---|---|---|---|---|---|---|---|
| 1680 | 58456 | p0003r03c13 | R0001 E7 | 3.09 | 0.424 | 0.137 | SQL1 |
| 1681 | 58458 | p0003r03c10 | R0001 F5 | 2.31 | 0.408 | 0.176 | SQL1 |
| 1682 | 58462 | p0003r04c16 | R0001 H8 | 2.22 | 0.257 | 0.116 | SQL1 |
| 1683 | 58469 | p0003r07c12 | R0002 F6 | 2.1 | 0.289 | 0.138 | SQLI |
| 1684 | 58470 | p0003r09c21 | R0003 A11 | 2.55 | 0.493 | 0.194 | SQL1 |
| 1685 | 58482 | p0003r12c19 | R0003 G10 | 2.16 | 0.36 | 0.167 | SQLI |
| 1686 | 58485 | p0003r12c10 | R0003 H5 | 2.48 | 0.273 | 0.11 | SQL1 |
| 1687 | 58501 | p0004r04c23 | R0005 G12 | 2.04 | 0.26 | 0.128 | SQL1 |
| 1688 | 58502 | p0004r04c03 | R0005 G2 | 2.17 | 0.289 | 0.133 | SQL1 |
| 1689 | 58505 | p0004r05c23 | R0006 A12 | 3.08 | 0.454 | 0.148 | SQLI |
| 1690 | 58507 | p0004r06c11 | R0006 C6 | 3.22 | 0.49 | 0.152 | SQL1 |
| 1691 | 58509 | p0004r07c15 | R0006 E8 | 3.26 | 0.421 | 0.129 | SQLI |
| 1692 | 58512 | p0004r09c03 | R0007 A2 | 3.16 | 0.559 | 0.177 | SQL1 |
| 1693 | 58527 | p0004r12c22 | R0007 H11 | 2.03 | 0.278 | 0.137 | SQL1 |
| 1694 | 58529 | p0004r14c09 | R0008 C5 | 2.26 | 0.45 | 0.199 | SQL1 |
| 1695 | 58531 | p0004r16c01 | R0008 G1 | 2.84 | 0.387 | 0.136 | SQL1 |
| 1696 | 58537 | p0005r02c08 | R0009 D4 | 2.03 | 0.355 | 0.175 | SQL1 |
| 1697 | 58539 | p0005r03c08 | R0009 F4 | 2.34 | 0.42 | 0.18 | SQL1 |
| 1698 | 58545 | p0005r07c21 | R0010 E11 | 2.96 | 0.361 | 0.122 | SQL1 |
| 1699 | 59319 | p0005r10c04 | R0011 D2 | 3.1 | 0.478 | 0.154 | SCL1 |
| 1700 | 59322 | p0005r12c01 | R0011 G1 | 2.16 | 0.255 | 0.118 | SCL1 |
| 1701 | 59348 | p0006r11c12 | R0015 F6 | 2.33 | 0.269 | 0.116 | SCL1 |
| 1702 | 59350 | p0006r14c13 | R0016 C7 | 2.41 | 0.447 | 0.185 | SCL1 |
| 1703 | 59363 | p0007r02c16 | R0017 D8 | 2.12 | 0.421 | 0.199 | SCL1 |
| 1704 | 59365 | p0007r03c20 | R0017 F10 | 3.07 | 0.584 | 0.19 | SCL1 |
| 1705 | 59370 | p0007r04c10 | R0017 H5 | 2.06 | 0.284 | 0.138 | SCL1 |
| 1706 | 59373 | p0007r05c23 | R0018 A12 | 2.95 | 0.472 | 0.16 | SCL1 |
| 1707 | 59376 | p0007r06c02 | R0018 D1 | 2.13 | 0.246 | 0.116 | SCLI |
| 1708 | 61050 | p0011r02c10 | R0033 D5 | 2.23 | 0.306 | 0.137 | SCL3/4 |
| 1709 | 61051 | p0011r03c23 | R0033 E12 | 2.9 | 0.298 | 0.103 | SCL3/4 |
| 1710 | 61052 | p0011r03c08 | R0033 F4 | 2.18 | 0.265 | 0.122 | SCL3/4 |
| 1711 | 61054 | p0011r03c16 | R0033 F8 | 2.11 | 0.415 | 0.197 | SCL3/4 |
| 1712 | 61056 | p0011r04c13 | R0033 G7 | 2.73 | 0.314 | 0.115 | SCL3/4 |
| 1713 | 61057 | p0011r04c10 | R0033 H5 | 2.45 | 0.463 | 0.189 | SCL3/4 |
| 1714 | 61060 | p0011r05c11 | R0034 A6 | 3.28 | 0.536 | 0.164 | SCL3/4 |
| 1715 | 61062 | p0011r06c21 | R0034 C11 | 2.73 | 0.526 | 0.192 | SCL3/4 |
| 1716 | 61063 | p0011r06c05 | R0034 C3 | 3.61 | 0.513 | 0.142 | SCL3/4 |
| 1717 | 61064 | p0011r06c04 | R0034 D2 | 2.58 | 0.477 | 0.185 | SCL3/4 |
| 1718 | 61065 | p0011r06c14 | R0034 D7 | 4.91 | 0.55 | 0.112 | SCL3/4 |
| 1719 | 61066 | p0011r06c18 | R0034 D9 | 2.38 | 0.285 | 0.12 | SCL3/4 |
| 1720 | 61069 | p0011r07c16 | R0034 F8 | 2.25 | 0.426 | 0.189 | SCL3/4 |
| 1721 | 61070 | p0011r08c21 | R0034 G11 | 2 | 0.234 | 0.117 | SCL3/4 |
| 1722 | 61071 | p0011r08c03 | R0034 G2 | 2.76 | 0.321 | 0.116 | SCL3/4 |
| 1723 | 61074 | p0011r08c16 | R0034 H8 | 3.02 | 0.399 | 0.132 | SCL3/4 |
| 1724 | 61075 | p0011r09c05 | R0035 A3 | 3.83 | 0.498 | 0.13 | SCL3/4 |
| 1725 | 61077 | p0011r10c21 | R0035 C11 | 2.12 | 0.306 | 0.144 | SCL3/4 |
| 1726 | 61079 | p0011r11c23 | R0035 E12 | 2.04 | 0.22 | 0.108 | SCL3/4 |
| 1727 | 61080 | p0011r11c15 | R0035 E8 | 2.76 | 0.299 | 0.108 | SCL3/4 |
| 1728 | 61081 | p0011r11c14 | R0035 F7 | 2.37 | 0.303 | 0.128 | SCL3/4 |
| 1729 | 61083 | p0011r12c15 | R0035 G8 | 2.29 | 0.351 | 0.153 | SCL3/4 |
| 1730 | 61085 | p0011r13c05 | R0036 A3 | 2.62 | 0.43 | 0.164 | SCL3/4 |
| 1731 | 61086 | p0011r13c09 | R0036 A5 | 2.53 | 0.398 | 0.157 | SCL3/4 |
| 1732 | 61088 | p0011r14c05 | R0036 C3 | 4.26 | 0.702 | 0.165 | SCL3/4 |
| 1733 | 61090 | p0011r15c07 | R0036 E4 | 3.16 | 0.429 | 0.136 | SCL3/4 |
| 1734 | 61091 | p0011r16c16 | R0036 H8 | 3.54 | 0.634 | 0.179 | SCL3/4 |
| 1735 | 61093 | p0012r02c03 | R0037 C2 | 2.2 | 0.265 | 0.121 | SCL3/4 |
| 1736 | 61094 | p0012r02c11 | R0037 C6 | 15.17 | 1.79 | 0.118 | SCL3/4 |
| 1737 | 61096 | p0012r02c08 | R0037 D4 | 2.44 | 0.27 | 0.111 | SCL3/4 |
| 1738 | 61097 | p0012r02c10 | R0037 D5 | 4.52 | 0.81 | 0.179 | SCL3/4 |
| 1739 | 61099 | p0012r03c02 | R0037 F1 | 3.34 | 0.39 | 0.117 | SCL3/4 |
| 1740 | 61100 | p0012r03c06 | R0037 F3 | 2.03 | 0.233 | 0.114 | SCL3/4 |
| 1741 | 61103 | p0012r04c17 | R0037 G9 | 2.48 | 0.413 | 0.167 | SCL3/4 |
| 1742 | 61105 | p0012r05c11 | R0038 A6 | 3.26 | 0.501 | 0.154 | SCL3/4 |
| 1743 | 61106 | p0012r05c08 | R0038 B4 | 2.46 | 0.354 | 0.144 | SCL3/4 |
| 1744 | 61110 | p0012r06c15 | R0038 C8 | 2.18 | 0.41 | 0.188 | SCL3/4 |
| 1745 | 61113 | p0012r07c09 | R0038 E5 | 2.47 | 0.376 | 0.152 | SCL3/4 |
| 1746 | 61115 | p0012r07c13 | R0038 E7 | 2.57 | 0.483 | 0.188 | SCL3/4 |
| 1747 | 61117 | p0012r07c24 | R0038 F12 | 2.18 | 0.235 | 0.108 | SCL3/4 |
| 1748 | 61118 | p0012r07c18 | R0038 F9 | 4.44 | 0.605 | 0.136 | SCL3/4 |
| 1749 | 61119 | p0012r08c03 | R0038 G2 | 2.97 | 0.35 | 0.118 | SCL3/4 |
| 1750 | 61120 | p0012r08c07 | R0038 G4 | 2.23 | 0.323 | 0.144 | SCL3/4 |
| 1751 | 61122 | p0012r08c18 | R0038 H9 | 2.23 | 0.373 | 0.168 | SCL3/4 |
| 1752 | 61125 | p0012r10c17 | R0039 C9 | 2.1 | 0.22 | 0.105 | SCL3/4 |
| 1753 | 61126 | p0012r10c16 | R0039 D8 | 2.47 | 0.345 | 0.14 | SCL3/4 |
| 1754 | 61130 | p0012r12c12 | R0039 H6 | 2.66 | 0.282 | 0.106 | SCL3/4 |
| 1755 | 61133 | p0012r13c24 | R0040 B12 | 2.25 | 0.27 | 0.12 | SCL3/4 |

-continued

| SEQ ID NO: | Seq. Ref. | Element (384) | Element (96) | Ratio | Mean Signal 1 | Mean Signal 2 | Library |
|---|---|---|---|---|---|---|---|
| 1756 | 61134 | p0012r14c23 | R0040 C12 | 2.23 | 0.228 | 0.102 | SCL3/4 |
| 1757 | 61135 | p0012r14c03 | R0040 C2 | 2.05 | 0.298 | 0.146 | SCL3/4 |
| 1758 | 61137 | p0012r14c02 | R0040 D1 | 8.63 | 1.463 | 0.17 | SCL3/4 |
| 1759 | 61139 | p0012r14c14 | R0040 D7 | 2.69 | 0.3 | 0.111 | SCL3/4 |
| 1760 | 61143 | p0012r16c02 | R0040 H1 | 2.55 | 0.318 | 0.125 | SCL3/4 |
| 1761 | 61144 | p0012r16c18 | R0040 H9 | 2.85 | 0.318 | 0.112 | SCL3/4 |
| 1762 | 61148 | p0013r02c19 | R0041 C10 | 2.33 | 0.463 | 0.199 | SCL3/4 |
| 1763 | 61151 | p0013r02c03 | R0041 C2 | 2.25 | 0.336 | 0.149 | SCL3/4 |
| 1764 | 61155 | p0013r04c07 | R0041 G4 | 2.13 | 0.366 | 0.171 | SCL3/4 |
| 1765 | 61156 | p0013r05c05 | R0042 A3 | 2.73 | 0.38 | 0.139 | SCL3/4 |
| 1766 | 61159 | p0013r06c24 | R0042 D12 | 4.57 | 0.831 | 0.182 | SCL3/4 |
| 1767 | 61160 | p0013r07c19 | R0042 E10 | 8.6 | 1.191 | 0.138 | SCL3/4 |
| 1768 | 61163 | p0013r07c18 | R0042 F9 | 2.18 | 0.278 | 0.128 | SCL3/4 |
| 1769 | 61167 | p0013r10c12 | R0043 D6 | 3.13 | 0.39 | 0.124 | SCL3/4 |
| 1770 | 61172 | p0013r12c03 | R0043 G2 | 2 | 0.396 | 0.198 | SCL3/4 |
| 1771 | 61173 | p0013r12c07 | R0043 G4 | 3.73 | 0.72 | 0.193 | SCL3/4 |
| 1772 | 61176 | p0013r13c04 | R0044 B2 | 2.34 | 0.446 | 0.19 | SCL3/4 |
| 1773 | 61177 | p0013r14c01 | R0044 C1 | 3.9 | 0.539 | 0.138 | SCL3/4 |
| 1774 | 61183 | p0013r15c14 | R0044 F7 | 5.49 | 0.959 | 0.175 | SCL3/4 |
| 1775 | 61185 | p0013r16c24 | R0044 H12 | 2.25 | 0.409 | 0.182 | SCL3/4 |
| 1776 | 61188 | p0014r01c07 | R0045 A4 | 2.14 | 0.271 | 0.127 | SCL3/4 |
| 1777 | 61192 | p0014r02c19 | R0045 C10 | 2.33 | 0.321 | 0.138 | SCL3/4 |
| 1778 | 61198 | p0014r04c24 | R0045 H12 | 2.3 | 0.321 | 0.14 | SCL3/4 |
| 1779 | 61201 | p0014r06c22 | R0046 D11 | 2.43 | 0.269 | 0.111 | SCL3/4 |
| 1780 | 61202 | p0014r06c08 | R0046 D4 | 2.57 | 0.346 | 0.135 | SCL3/4 |
| 1781 | 61204 | p0014r07c07 | R0046 E4 | 4.27 | 0.516 | 0.121 | SCL3/4 |
| 1782 | 61206 | p0014r07c12 | R0046 F6 | 2.18 | 0.364 | 0.167 | SCL3/4 |
| 1783 | 61210 | p0015r09c02 | R0051 B1 | 2.43 | 0.463 | 0.19 | SCL3/4 |
| 1784 | 61212 | p0015r10c15 | R0051 C8 | 2.64 | 0.406 | 0.154 | SCL3/4 |
| 1785 | 61216 | p0015r11c16 | R0051 F8 | 2.28 | 0.278 | 0.122 | SCL3/4 |
| 1786 | 61225 | p0015r14c12 | R0052 D6 | 2.25 | 0.25 | 0.111 | SCL3/4 |
| 1787 | 61226 | p0015r14c14 | R0052 D7 | 2.54 | 0.3 | 0.118 | SCL3/4 |
| 1788 | 61227 | p0015r16c18 | R0052 H9 | 2.06 | 0.312 | 0.151 | SCL3/4 |

The ratio of signal 1 to signal 2 in the table above provides a measure of the level of expression of the identified sequences in tumor versus normal tissues. For example, for SEQ ID NO: 1669, the tumor-specific signal was 3.09 times that of the signal for the normal tissues tested; for SEQ ID NO: 1670, the tumor-specific signal was 2.31 times that of the signal for normal tissues, etc.

EXAMPLE 7

REAL-TIME PCR ANALYSES OF LUNG TUMOR SEQUENCES

Real Time PCR was performed on a subset of the lung tumor sequences disclosed herein in order to further evaluate their expression profiles in various tumor and normal tissues. Briefly, quantitation of PCR product relies on the few cycles where the amount of DNA amplifies logarithmically from barely above the background to the plateau. Using continuous fluorescence monitoring, the threshold cycle number where DNA amplifies logarithmically is easily determined in each PCR reaction. There are two fluorescence detecting systems. One is based upon a double-strand DNA specific binding dye SYBR Green I dye. The other uses TaqMan probe containing a Reporter dye at the 5' end (FAM) and a Quencher dye at the 3' end (TAMRA) (Perkin Elmer/Applied Biosystems Division, Foster City, Calif.). Target-specific PCR amplification results in cleavage and release of the Reporter dye from the Quencher-containing probe by the nuclease activity of AmpliTaq Gold™ (Perkin Elmer/Applied Biosystems Division, Foster City, Calif.). Thus, fluorescence signal generated from released reporter dye is proportional to the amount of PCR product. Both detection methods have been found to generate comparable results To compare the relative level of gene expression in multiple tissue samples, a panel of cDNAs is constructed using RNA from tissues and/or cell lines, and real-time PCR is performed using gene specific primers to quantify the copy number in each cDNA sample. Each cDNA sample is generally performed in duplicate and each reaction repeated in duplicated plates. The final Real-time PCR result is typically reported as an average of copy number of a gene of interest normalized against internal actin number in each cDNA sample. Real-time PCR reactions may be performed on a GeneAmp 5700 Detector using SYBR Green I dye or an ABI PRISM 7700 Detector using the TaqMan probe (Perkin Elmer/Applied Biosystems Division, Foster City, Calif.).

Results obtained from Real-time PCR analysis of a number of lung tumor-specific sequences disclosed herein are summarized in the table below. In addition, extended cDNA sequences for many of these clones were obtained by searching public sequence databases. The extended sequences, and the proteins encoded by those sequences, are identified by SEQ ID NO: in the table below.

| Library | Clone Name | Clone No. | SEQ ID NO: | Real-Time PCR Results | Extended cDNA Sequence | Encoded Polypeptide Sequence |
|---|---|---|---|---|---|---|
| SQL1 | L972P | 47988 | 1789 | Overexpressed in 1/7 lung squamous tumor, 1/3 HN squamous tumor. Low or no expression in normal tissues. | | |
| SQL1 | L979P | 48005 | 1790 | Over-expressed in 2/7 squamous lung tumors, 1/3 HN squamoustumors, 1/2 adeno lung tumors. Low or no expression in normal tissues. | 1791 | 1806 |
| SQL1 | L970P | 49853 | 1269 | Highly overexpressed in 1/7 lung squamous tumors and 1/3 HN squamous tumor. Low or no expression in normal tissues. | | |
| SQL1 | L981P | 49865 | 1272 | Over-expressed in 1/6 squamous lung and 1/3 HN squamous tumors. Low or no expression in normal tissues. | | |
| SQL1 | L980P | 49826 | 1279 | Over-expressed in 3/7 squamous lung tumors, 1/3 HN squamous tumors, 1/2 adeno lung tumors. Low or no expression in normal tissues. | 1792 | 1807 |
| SCL1 | L973P | 20631 | 117 | Over-expressed in atypical carcinoid METs and adenocarcinoma. Expression in several normal tissues. | 1793 | 1808 |
| SCL1 | L974P | 20661 | 128 | Over-expressed in primary small cell, squamous and adenocarcinomas. Expression observed in several normal tissues. | 1794 | 1809 |
| SCL1 | L996P | 50430 | 1442 | Over-expressed in 2/2 Primary Small Cell, 6/6 Small Cell Cell Lines, 1/1 Atypical Carc. METs, 1/1 Adeno, 1/1 Squamous. Very low or no expression in normal tissues. | 1795 | 1810 |
| SCL3 | L977P | 26961 | 288 | Over-expressed in 1/2 Primary Small Cell, 1/6 Small Cell-Cell Line, and 1/1 Carcinoid Mets. Very low or no expression in normal tissues. | 1796 | 1811 |
| SCL2 | L978P | 24928 | 1339 | Over-expressed in 2/2 primary small cell, 3/6 small cell-cell lines, 1/1 carcinoid mets., adeno and squamous tumor pools; Low or no expression in normal tissues. | 1797 | 1812 |
| SCL3/4 | L984P | 50507 | 1446 | Highly expressed in 1/2 primary small cell tumors and 4/6 small cell tumor cell lines. Low or no expression in normal tissues. | 1798 | 1813 |
| SCL3/4 | L580S | 50536 | 1449 | Over-expressed in select small cell and squamous tumors. Some expression observed normal brain, bronchiol, soft palate and trachea. | | |
| SCL3/4 | L988P | 50645 | 1531 | Over-expressed in 1/2 Primary Small Cell, 1/2 Primary Small Cell, 6/6 Small Cell-Cell Lines, 1/1 Carcinoid Mets., Adeno & Squamous Tumor pool. Expressed in some normal tissues (brain, adrenal gland, salivary gland, trachea, thymus). | 1799 | 1814 |
| SCL3/4 | L1423P | 50625 | 1533 | Over-expressed in 1/2 primary small cell , 5/6 small cell-cell lines, 1/1 carcinoid mets. Also expressed in normal brain and pituitary gland. | 1800 | 1815 |
| SCL3/4 | L986P | 50483 | 1490 | Over-expressed in 1/2 primary small cell, 516 small cell-cell lines, 1/1 carcinoid mets., adeno and squamous tumor pool. Expressed in normal brain, pituitary gland and spinal cord. | | |
| SCL3/4 | L987P | 50560 | 1527 | Over-expression in 1/2 Primary Small Cell, 6/6 Small Cell-Cell Lines, 1/1 Carcinoid Mets. Expression in normal pituitary and adrenal glands. | 1801 | 1816–1818 |
| SCL3/4 | L1424P | 50639 | 1547 | Over-expression in 1/2 Primary Small Cell and 1/1 Carcinoid Mets. Low or no expression in normal tissues. | | |
| MLN1 | L997P | 26749 | 730 | Over-expression in 1/1 atypical carcinoid METs. No expression in normal tissues. | | |
| MLN1 | L999P | 26752 | 733 | Over-expressed in 2/2 Primary Small Cell, 6/6 Small Cell Cell Lines, 1/1 | | |

-continued

| Library | Clone Name | Clone No. | SEQ ID NO: | Real-Time PCR Results | Extended cDNA Sequence | Encoded Polypeptide Sequence |
|---|---|---|---|---|---|---|
| MLN1 | L1400P | 26529 | 405 | Atypical Carc. METs. Expression in several normal tissues. Over-expressed in 2/6 Small Cell Cell Lines and 2/2 Primary Small Cell. Moderate to low expression in several normal tissues. | | |
| MLN1 | L998P | 27699 | 468 | Over-expression in 1/1 Atypical Carcinoid METs. Low expression in normal tissues. | 1802 | 1819 |
| LAP1 | L1425P | 59303 | 949 | Over-expressed in 4/7 squamous tumors, 1/2 adenocarcinoma tumors and in a pool of six small cell lung carcinomas. Moderate to high expression observed in normal brain, kidney and skeletal muscle. | 1803 | 1820 |
| LAP1 | L1426P | 59314 | 1156 | Highly overexpressed in one lung squamous tumor and one HN squamous tumor. Very low or no expression observed in normal tissues. | 1804 | 1821 |
| LAP1 | L1427P | 59298 | 921 | Highly over-expressed in 3/12 adenocarcinoma tumors. Very low or no expression in normal tissues. | 1805 | 1822 |
| LAP1 | L1428P | 59316 | 1180 | Over-expressed in 4/12 adenocarcinoma tumors and lower level expression in several other adenocarcinoma tumors. Very low or no expression in normal tissues. | | |

From the foregoing it will be appreciated that, although specific embodiments of the invention have been described herein for purposes of illustration, various modifications may be made without deviating from the spirit and scope of the invention. Accordingly, the invention is not limited except as by the appended claims.

SEQUENCE LISTING (1825 sequences)

SEQ ID NO: 1 - DNA, 527 bp, Homo sapien
ccaccagtccacaaatgtgactggtaagggatctagtaacagaggatggagttgggcagaatattatcctggatgatatgcacccagcactagaatacacctttcattagaatgaagagaacagacaaagccctcagaaaagatacaaaggcagagacattgattagaacattatctcataacagaggtggggccattacccaccattattgtaaaataactgtaactaaccaaaacacatacaggcttctttaatggagttaataaaactatggcacattgggaatcaggggcagaggtactgttcccagacggaaaactgggataaagggagccatgctgacagggccttattccagtctaggttgttagaaaggagccctagcccagaaatgacagcaaatagccataatcattatgtggggctgaaccagaggaagccaggctgagccaagaagctggaagtatcttgaacggctctccaaatccaaagattatccatactctttatccctccagcgatgtgt

SEQ ID NO: 2 - DNA, 490 bp, Homo sapien
ccaagagttctccactgtgaagactgaaaggacctggtgacatttcggcatcagtcctgttaccacttggaggtaacagaagcaggctcgtgtcctcctttaattctaccacactacatgactcgcaattggttctgaaattagaacgttcaccatcgtacttaaaatcttaggggcatgaagagtcagctagaacaaggaaaaagaaagtcgcaggtagtaggtaagtaggtgggcacatgaaaagccaagctgctctgtccaacaccagtgtacatgtgctttaactaaatgaactccagaggccaacagcagcagacctgctcaattcaccttccaaatcagaacaagaccaaaaagctcaggcttgagttgtcaactatgcataggttccgccagtgctgaggggtgtgaggctctagttgtgaagaagctacaagaaatcatgatgcatgtgatctgggccgcactggcatttgcagctattcag

SEQ ID NO: 3 - DNA, 464 bp, Homo sapien
ggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagtttaaatttcagcttccctactttgtaattgactgact

SEQ ID NO: 4 - DNA, 510 bp, Homo sapien
ccttatcacactgtaagtggtccaagcccatagggatgctctttttggttcctggaatttccagttggatgtgacagagatctttcagtataggtctaagtcaagagtagcctctgggttgaggtgggctgggagattaacatcttacctggggtccttcagataaacctgttggtttttcctgtctcatacaggcccatcttaagttttgatgttgaattaaaactacttctacccccttagttataaaaaaggccacaaggagcatttatgtggatatctggaagtgagatagttattccattcccaggaaaagaaaaataaagctaagttacaaaactaaatctatatgcaataaagttattatatactgctttgtttaagcagagtcctctggaatttatgtacagtacattagttttcagctatttatattccacaagttagaccttaagattctctggttttaagacaattgttaaagatacttctaaagctctgagcagttca

SEQ ID NO: 5 - DNA, 452 bp, Homo sapien
acagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggtaaatcatctcctttatttggtgcctcatgtgagtactggttccaagtgacatgacccagcgattatgtttacagtctggacttctgatcaagagcgttcttgaaattttccttcagttttaagacattttcatgcaggcagagtgttcttcccctaaaggcacttgacactcatttttt

SEQ ID NO: 6 - DNA, 336 bp, Homo sapien
tatagagtgctgacatctgacattgagaaattcatgcctattgtttatactcccactgtgggtctggcttgccaacaatatagtttggtgtttcggaagccaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaa

SEQ ID NO: 7 - DNA, 376 bp, Homo sapien
ctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttattttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctg

SEQ ID NO: 8 - DNA, 406 bp, Homo sapien
ggtagggagcaattctattatttggcattgcatggctgggttgaattaaaacagggagtgagaacaggtgagtctagaagtccaactctgaaaaggaccactgtacatttgaacacacggctgtgttaaagatgctgctaatgtcagtcactgggtgcactaaaggatctcttattttatgtaaaacgttgggattgacaagatagatctgatactctgttaagttaccctctgaagctacttcttgtgaaatactaatgacagcatcatcctgccaagcgaaagaggcaggcataagcaaggacaaattaaaagggggtaagagccttatcatgatgaggagtcttgttttgacatcttgggaaaagctgtccatagtgtgaagtcgtcaatttctcaccatggt

SEQ ID NO: 9 - DNA, 330 bp, Homo sapien
actactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctgg

SEQ ID NO: 10 - DNA, 449 bp, Homo sapien
ctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgcgggtaagttgaggttatcttgggataaagggtcttctagggcacaaaactcactctaggtttatattgtatgtagcttatattttttactaaggtgtcaccttataagcatctataaattgagttctttttcttagttgtatgg

SEQ ID NO: 11 - DNA, 472 bp, Homo sapien
cctcgatgcatgctgctctacctctcatcagcccacagtctgacacgaggtcatctttggtctgtggtgaggtatggatgtctgcagtctacacaacagccctgcagaacgggcctggacaacccttgggggataagacagccacacatggctcaggctgttaggtgtccactgtcacagtccaaagagaaaggtacggcctccaagggggcagcttaagccaacatgtaagacttgggcacgatgaaaggacgggggtccagctacgaatgtttttgttcttgatgtcaagttgccagctactggaaggcaggagcagtttcttctttttcccactctgtgctgggtacttgggagaggcgaaataaataccagactgtccactcctcagcctaaggtccttctcaagtcctgcacactcagcacttgctctttaacgtggcatatgttcccccatcttcccctggtaatg

SEQ ID NO: 12 - DNA, 371 bp, Homo sapien
ttttttttttttttttttttttttggaratttgkcacattttattcagwatttctgctgcactgccagcctagggatgcacttgattcccaagaaatgcaactgtcctattcgcaragccgtccacaggtacctaccccctggactgcagcaactttattaccttaactagcacaraacagaggttgatttaaactccttacactcacttctcaratcaatgaatgggcaaaraaacmcctcatggctctgggaaggcatgctgaracccgtttttgcaagtcctgaggaatggaaraatatagctgccaggtatcccaagtctagggcagggagggkagtatcggcatcactttcactgcattctgttgg

SEQ ID NO: 13 - DNA, 493 bp, Homo sapien
  misc_feature (1)...(493): n = A,T,C or G
ccagtccaacctgctcctcattattgtataaatgagcagaatcaatatggcggaagccagctycaattgccaatttggtggcctctaaagctttacttttaggaacctctgcaggcgcataggtgccaaatcccaggacaggcatgaagtgaccatcattcagcttcacacactgatatttcgaatccatttctgtcnnnnnnnnnnnnnnnnnnnnnnnnnnnnnnnnnnnnnnnnnnccaacctgctcctcattattgtaaacatgtgcagaatcaatatggcggaacccagcttctattgctaattttgtgacctccaaagctttacttctcggaaccttggttcttccgagcgctcagcaatcccgccgagcttctttgagacgtcctcaggtgtcctttgacgatgcgtcctccactttcacacactctagcattccttcactggggtcttcattgccccacattgggcagccaggaatgttggggtg

SEQ ID NO: 14 - DNA, 540 bp, Homo sapien
ccagatggtccataatatgtcaccgagcaggtgaatggcatttgtatgtcagccttggttgtcttgtactccagggtggaagtcatggtatagagctgagtcactgggtccatttcctttttaaaattatgaccaccgctccttcaaggggatgtagcacttttccattcctgtaccatgtgatattgccatctggataactgtcttctgaaatgcagtcacccaacttttttagctgctctgtttcgagaaacagtgctttgcttacaatttcaggtttagatggttgcttgaacaccttgactattgtaggtgcctcaaacacgttgtcctcagttactagcatgcacacaaatctcttttcatcactgatccttgcattactgatagacaaagtgtagttttctgagaggttcaatctgtctttgtattctggtacatcgtcgtactgcacacttttctttgtagaggatctgaaggcaataaatactggggagccatcgggcttttcatatttccatttgcccaaacatgagattc

SEQ ID NO: 15 - DNA, 421 bp, Homo sapien
tacccacctccagcctcccatgtgagcctgtccttatgtatagtgtccaacctctgattctagcagtcaagtgtcttccccaatcctaatgtcccctgatatgtctctagcgacttgaccatctcttgttccttgggactggggccagcctcttgtctgcccacttccctctcattagtcagatagccccaaaggctctatctttagctcccagagaactttttggtcctcagtatttcccttcccctttccttcctattccccacaactgggggagggaagggagaacaggggcacctgatcatcaatctcccctgcccctctcttgaagccccctagatttggatgaagagcaggccagtgagcagggcaaagcctgctaggagcagaatgaccttgaggatcctttgctcagaactgg

SEQ ID NO: 16 - DNA, 236 bp, Homo sapien
gccgtgtgtgcttttcccagtgccgaggtacctatcgctcacggccaggagcttgtcgtggctgacagcaaagagctgctctctgtgggcctgcttcatctcatccgagaggccgtacaagaagtggtccattcctttgtctgaaggagcgacaggagcatctacggttgagaagacagaaagtttggcttcgtcgatgtcttgctgtgtgaattttccagacttagcccagtcga

SEQ ID NO: 17 - DNA, 424 bp, Homo sapien
ccagaaaggtgacagtggttttccagggcctcctgggcctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacatcgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatgg

SEQ ID NO: 18 - DNA, 154 bp, Homo sapien
gtcaccaactccttcagcgcctccacagggstttcggacatgacagcaaccttttctcccaggacaattgaaatttgctaaagggaaaggggaaagaaagggaaaagggagaaaaagaaacacaagagacttaaaggacaggaggaggagatgg

SEQ ID NO: 19 - DNA, 445 bp, Homo sapien
caacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaaagtgtgactatgaaaatgttccaaccactgtatttactcctttggaatatgg

SEQ ID NO: 20 - DNA, 211 bp, Homo sapien
gggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttgg

SEQ ID NO: 21 - DNA, 396 bp, Homo sapien
tgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattgg

SEQ ID NO: 22 - DNA, 277 bp, Homo sapien
ggaaccatgtggccggcgcccttgatcgtgagaaaggcgatgtgggagaactccttcacgaagccggcaatctgctccccgctgtccccgtacttcactaaccagggccggcgctgcacctccatcttctggttgagggaatccacaaaccactcatcccccatgaaattgcaggccatgtctacatctccattatataataggatctgggatttctgtgagctaagcagcttcagatactgggagttcatgcttcggtagagacggcggtactgta

SEQ ID NO: 23 - DNA, 634 bp, Homo sapien
tctgaccatccatatccaatgttctcatttaaacattacccagcatcattgtttataatcagaaactctggtccttctgtctggtggcacttagagtcttttgtgccataatgcagcagtatggagggaggattttatggagaaatggggatagtcttcatgaccacaaataaataaaggaaaactaagctgcattgtgggttttgaaaaggttattatacttcttaacaattctttttttcagggacttttctagctgtatgactgttacttgaccttctttgaaaagcattcccaaaatgctctattttagatagattaacattaaccaacataattttttttagatcgagtcagcataaatttctaagtcagcctctagtcgtggttcatctctttcacctgcattttatttggtgtttgtctgaagaaaggaaagaggaaagcaaatacgaattgtactatttgtaccaaatctttgggattcattggcaaataatttcagtgtggtgtattattaaatagaaaaaaaaaattttgtttcctaggttgaaggtctaattgatacgtttgacttatgatgaccatttatgcactttcaaatgaatttgctttcaaaataaatgaagagcag

SEQ ID NO: 24 - DNA, 512 bp, Homo sapien
gcaaaacaagcctaagcaagcacaacgaagagcagaagtcagtgaaattaaaaagaggaaaaagaaaaatcataaaaatcataaaaagttatttctttgaaaagatcaatgaaatttagcaagactgacacagataaaaaggaattagacccaaatcagtgaacaggaatgaaatagaggatatcactacagaggctgcagccattgaaaggataattaggaaatcccacagataactttgtgctcataaatttgacaatgtagaggaaatatctttagttttaattagctttttattttagtttttctcaaaaactaaaacttaataaaactcaaccaagacaaaatagacaatcagaatgtaggcatacctcagagatgtggcggatttggtttcagactactgcaataaaccaaatatggcaataaaaggagtcacagaaagtggtttcccagtgtatatatataaaagttacatttactctatgaagtgcaataacattttgtctaaa

SEQ ID NO: 25 - DNA, 461 bp, Homo sapien
ctctgtttcagcacctcattgggattattgaactcattaaattctttacatgaacttgaattgttcattgaaatctctagccatttccctggttaaacaggataatctttttttttcactaaagaacattcgtggtggtttagtgatgaggttaatattcccctcttgtccacctccacattggaaaaaccacgttggactgagttttgaggagcaaagaactaatcacttgaccaaaggggccctgtatccccacaagccctgggtatttttctctcatagagagaagagggtctgtatggatacctgaaaatgtgattttatatattcttggcatccaggggagaaaaatcaaaaagcaaggaagttacagttatctccccagaaattaatgggtcatgtcaagactataggttttcatttccttctgttgcttgttagaatgatgttcttgtgggaaa

SEQ ID NO: 26 - DNA, 317 bp, Homo sapien
tgctggagtcggaactgctgcctttgtttggcggccttgtttcttaaatcagttccctcttaggatttattacactaaaaaaaaattagtttttgaaaagaaataggagaatacagaaacatgaatttcacgaggctatcatctaacagtgggggctttctacacacgtggtgccaaaatgtgtcattctgagtcaattgcaattcctctctaggagtgaaaagagataaaagataagccaagaaccctggacagattcttggtgttggtgacaaagaggaaaggacctgagaatggggctggtggggagagggggg

SEQ ID NO: 27 - DNA, 250 bp, Homo sapien
taattgctgtgattattagaattctatcatgactgtattgtagtttttgctctattycagataagcmagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaa

SEQ ID NO: 28 - DNA, 532 bp, Homo sapien
cctatatcattcatttatacagaagctgcttgctgcttagcaagttggtgggtttgattttccttggttgctttgcagacctcccttgagaggattccttctggatggagatttctttgttgctgtctcccttgccacaactctgaccaagattgcattgcgctatgtagctttggttcaggagaagaaaaagcaaaattcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaagaaagaatctgaaaagaggaatgtgacagtacagcctgatgaccccatttccttcatgcaactaactgctaagaatgaaatgaactgcaaggaagatcagtttcag

SEQ ID NO: 29 - DNA, 486 bp, Homo sapien
ctgtttttggacttaattaacywttgcaagtggaaaccaagaaataattgtagcataactctctctattgtcatgttgcttctttctgcaaatatatcttacaagttagactttaaacctttgatctcccacaccaaaagagaaaataatatttatatggaagtaattttattttagtgtttgtgatttattgtggagagcaggbgtttaaaaattttagaatttctttttaacaaaatcaaatacattgttaaggtaacaaagaataattcactatttcagcatttcaaagcaacatattctacaacttcaaagatatttgcaaaaataatacaactgttgaagttcaaatgttatggaaagaaacattagaagtatgaaaagtggtacaaaaacatgtttctttttattctcttggatatatatctatatatttaggaaaatacatatatgtatgtgtatgtatatatatgtatgaaaatatac

SEQ ID NO: 30 - DNA, 240 bp, Homo sapien
aagacctgaggaaggaaaacaaattggcttcctgctgaagaakcaaaatagacattttttaatgtctcttgaccccagttccaagttcaccctgttgcctgttcttcctcccaccttttggggttctataactgcatcccccacacatctttcaccaccaccccatacataccagctctcctgttgtgggattcaggacataggaagagttgctgaaggcacgggtgcttttgggattcg

SEQ ID NO: 31 - DNA, 233 bp, Homo sapien
ccattgatgcaggatatcggcacattgactgtgcctatgtctatcagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactgg

SEQ ID NO: 32 - DNA, 233 bp, Homo sapien
gaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctagg

SEQ ID NO: 33 - DNA, 319 bp, Homo sapien
ctgggcctggatggtctaggatagccttactcacttgcctggcaggtgacaggctgttggctggaattgcttggttctcctccatgtggcctctccagtaggctagctcaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtgg

SEQ ID NO: 34 - DNA, 340 bp, Homo sapien
tacagatttaattcatgttattaactccctgccttttacctcctccctcctcccttggcacaactgccagatggatgtggctggaagtcagaggacattctcgtgggttcgtgggcctagggtacaaatgacctcagcgtgacagcaaacaggacagagaagaccaggctcttactcaggaatccaccagccaggagaatgacaatgttgaacaccggaaccctgatgatatctgtcacatttgtaaggttgatttcagagtcaggagtggagacatcggcagttgacttgggtggagcttgggtcacagttctggggctggtatagagtgggcacaagg

SEQ ID NO: 35 - DNA, 170 bp, Homo sapien
acatgggtccttcactcctcgctgagatgttgcggcagccttttcttccaatgcggttgtggcaggagaatccacggatgtaatgttttcacctttttccctgagggtgctttctgaggaaccagyccttaagaggtggggtcttggattcctgacccaggcgtccggca

SEQ ID NO: 36 - DNA, 475 bp, Homo sapien
ctgtttttggacttaattaaccattgcaagtggaaaccaagaaataattgtagcataactctctctattgkcatgttgcttctttctgcaaatatatcttagaagttagactttaaacctttgatctcccacaccaaaagagaaaataatatttatatggaagtaattttattttagtgtttgtgatttattgtggagagcaggtgtttaaaaattttagaatttctttaacaaaattctaaagagaaaataaaaaagaaatcacagtatttacagagataacagaatggcttagccatgcaaaacaaataactttggtttttccccttttactttggtttaaatgttgaccaagattcaattttttttcctgccaaataaaacttcaataaaagtttagaggcaaaataacgtattttctttttttcccataatattttatacagcatcgagtctaagaatattttatgcattt

SEQ ID NO: 37 - DNA, 246 bp, Homo sapien
ccttgagcttgggccgggcactgaggcgccccacatatgctgagagcagggggaacgcatccaggcagccaggggctaggacctcatggatcagcagcaagtccagcaggttgtagtcagcgaaggagatctggtctcccacaatgaaggtcttgcctccctggttctgggacagcagggtctcaaaaggcttcagttgcccgggcagtgccttcacatagtcatccttgcccacctcatagttgg

SEQ ID NO: 38 - DNA, 512 bp, Homo sapien
gctggaagtgaaatgcagatcagacccattgtgatgtcacagaaagatggggacaggccaaagaaaaaagtgactttcaactcttcttccatcatttttatcatcaccagtgatgaatcactgtcagttgacgacagcgacaaaaccaatgggtccaaagttgatgtaatccaagttcgtcctttgtaggaatgaagaatggcaacgaaagatggggccttaaattggatgccacttttggactttcatcataagaagtgtctggaatacccgttctatgtaatatcaacagaaccttgtggtccagcaggaaatccgaattgcccatatgctcttgggcctcaggaagaggttgaacaaaaacaaattcttttaattcaacgggtgctttacataatgaaaaaaccacttgtggcacacgatgggcatctaacatcatcatcttctaatgtgttggagattttcatttcaaatatattttttaaattactctattttccaaaacacgtaat

SEQ ID NO: 39 - DNA, 370 bp, Homo sapien
ttttatgaacaagatataaggatcaaaaaaaagggtgttgatatgtttttccaagcagagatgtactcgactctgtcctatttagccttcccatacctgacttctaatcacttttcctggtgccctyccatctccctaaccccccctcacagggatgcctcctcccaaggctccagaaactctgaccctcgcactgctggagggagcccatgaattgctggtcaatatcgctcatcctctakactccatcctgcgtgtgcttcttcctacaagagctagagaggcactgactgataaatacctgtcacctgcccctttcccagagggtgaaactccacccactcccactgcagaaatgaatcttaaatgg

SEQ ID NO: 40 - DNA, 204 bp, Homo sapien
cctgagggttttccctttaaattttcattgagttgtccatctccagcatatagggcttcaggagcagagcagaccttgtttttagtggttccatgggataaaatgggattggaggagctagaagaattcagggtctggtccaatctgccagtcttcctgaaatatcgaaaatacaccagggctgctatatcagagccaccctgg

SEQ ID NO: 41 - DNA, 447 bp, Homo sapien
caggcagcaattcgtaaagaattaaatgagtacaaaagtaatgaaatggaggtacatgcatcaagcaagcacttgacaagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtagtggaggacgggcaacgtgcatgtgcaggctcaccactcccagg

SEQ ID NO: 42 - DNA, 498 bp, Homo sapien
ctggttttgtaaaaacagtctctttattctactgtgctgaaaccctcaccaatatagaaaattagattctcattgcactgaactatatttatatgcctaagtatgtagaagtaaaattatataccccaaaaggattttatcttgttgtatatattaaatgttatttctgcatatagggtcttttatggagaaactgatgatgataagcttaatactcacttgtttagcagcatctgaatgcacaaatgctttatatatctcttctgctttacagggcaaaagatcagactctgttttcttatagtcttcacaagccagccagaactcaatattctcctcactgaattcagactttaggaaacttccaaagacattttgaccagtttggttggcaagaagtttttccagagattgagaccattgcattacttcagcagcagaaagtacatccttggacttggaagatttcattccagattccagatgtgggatcataga

SEQ ID NO: 43 - DNA, 312 bp, Homo sapien
caggaaggcggccaagaatgtgagtgcaaagattggttcctgagagccccgagaagaaaattcatgacagtgtctgggctgccaaagaagcagtgcccctgtgatcatttcaagggcaatgtgaagaaaacaagacaccaaaggcaccacagaaagccaaacaagcattccagagcctgccagcaatttctcaaacaatgtcagctaagaagctttgctctgcctttgtaggagctctgagcgcccactcttccaattaaacattctcagccaagaagacagtgagcacacctaccagacactcttcttctc

SEQ ID NO: 44 - DNA, 417 bp, Homo sapien
ctaacacatttactctccactattcgtactctggtagccatgttaaccccatcagagattccttctcaagccatgtctcagagctgagaggcatcccagcaagttttgcagctcacagttttttccgtaaattacttattctataaaattggagtaggccataaactttggagggccctagaccaattttttggattatttttcgtcttctatcattccgctgatcttagatattctctgcattaaatattaaatatcacttctaggctgaaaaatccccctaaaaatatttctagctcagatttttcctccaaattctgcaatagaagatcacaatgtgaactctgcatctccatgttaaagtctaatggacattcacacttagcatgtctcaaagaaatctcatgtaaaccatgg

SEQ ID NO: 45 - DNA, 494 bp, Homo sapien
cgcgtgtctgtggtatgtgtacacgtgcatgttctgcatgtctgtaggtcacacatgctttggtgcatgtacacgtgtgtgtgtgtatgcgtgtaggagctcacacttgtgtacacgtttgtgtgcatgcatgtgtgcaggagcttgcacgtttgtggtgggtacatgtacatatgtgagtgatcctgtgtgcaagcccccatgtggacatggctatgagtgagcgtggagccaaaagccaggtaacacgcatgcagcaggcccactgtgcgtgtctgagacggtctgtggcagggactgggtgtgaatcatgcagcaggcccactgtgcgtgtctgagacggtctgtggcagggactgggtgtgaatcagtgaccgtgtctctgaccaacatgctgaattacaaattgataatttattaacctgtgcagcaacaaataagatttttcaaaactcaacaaagtgctcaaagttgacattacttgcttcaaagtt

SEQ ID NO: 46 - DNA, 516 bp, Homo sapien
ccagtccaacctgctcctcattattgtataaatgagcagaatctatatggcggaacccagcttctattgctaattttgtgacctccaaagctttacttctcggaacctcctcctttggccgtcatttgatcattcaactctttgtcagtggcaactcccgctattttggtgtgttggtttgttactacacagtgagcacaaacatggtggtccaatacagaggctcttcctgtcaggtgtcaaccagaaagttcatctaacactgtgatatttgcatccttcttgaacagttgttggctgaagattcatttgatgaatcgatttttcaaaagagatgattcttggttcttccgagcgctcagctctcccgccgagcttctttgagacgtcctcaggtgtcctttgacgatgcgtcctccactttcacacactctagcattccttcactggggtcttcattgccccacattgggcagccaggaatgttggggtgatcagacacaacaccaggtcatg

SEQ ID NO: 47 - DNA, 459 bp, Homo sapien
ccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgaksaaaaaaaaaaaa

SEQ ID NO: 48 - DNA, 430 bp, Homo sapien
cctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtgg

SEQ ID NO: 49 - DNA, 288 bp, Homo sapien
ccatccgaagcaagattkcagatggcagtgtgaagagagaagacatattctacacttcaaagctttggwgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggccrtggagaagtgtaaagatgcaggattgg

SEQ ID NO: 50 - DNA, 411 bp, Homo sapien
ccagagaatgacattcatgtccccgtggatcccttgcagagagtacatggagccactgccaccagtggtgatggaaagcactgtcttcttactccggaagggtcctttgtcatacatggcagcgtaagtgtaagcaaactctcctatgaacactcgctcaaaccagcctttcagaatggcagggactccaaaccactgcagggggaactggaatatcacaaggtctgcggcttccagcttcttttgttcagccacaatatctgggctcagatggccttctttataagccagaacagactcggcaggatactgaaagttcgcagggtccttcagtttacctgtgatgtcctttctggaaatgatgggattgaagttcatggcatagaggtccgactccaccacctcccatcc

SEQ ID NO: 51 - DNA, 503 bp, Homo sapien
gatatcttatgattaaaaacaaattaaattttaaaacacctgaagatatattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattaaga

SEQ ID NO: 52 - DNA, 503 bp, Homo sapien; identical to SEQ ID NO: 51

SEQ ID NO: 53 - DNA, 531 bp, Homo sapien
tttttttttttttttaaaatgaggatattttattatttcaggtaattttcccagaggkgagaatagtacatgggaaattctctttaggccaggtctagtattacagkgtggkgctcaaggccgcccatcagaacagtgatactctcccaacagatttcatccaccccgtctccactaacttttgccataaaaattcctctgaattgtatcttcttggaagaagtaaatatctgttcgactatacaaagaaacagagaaaccactcccattgcaatcaatcttcaagagagggagcaggcaagccgtgttctttctgctgagttttatagactctgacaagctgtgaaataaacataaacagaagacaaaacagtgccacaaataagcagtagatgaccctgtgacaagacggcattgcagaacaaagactgacgtttaaaggggagtcatgcagagtaacatgggaacacaagcctgacaacctggtcagcttccacttactctagctcctttgaactctcaacactaaaa

SEQ ID NO: 54 - DNA, 450 bp, Homo sapien
ccatgggtgtctggagcwccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcag

SEQ ID NO: 55 - DNA, 648 bp, Homo sapien
caacttcaaccacaggctgctggasatgatcctcarcaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctrcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggygayttcagcaagctacagcaaagcccattggccggaaaaaatatcaagggtcaaat

SEQ ID NO: 56 - DNA, 536 bp, Homo sapien
ctggcatgagaatatttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttaaaactcttctctattataacagtcaatttctgactcacagcagtgaacaaacccccactccattgtatttggagactggcctccctataaatgtggtagcttcttttattactcagtggacctgcccgggcggccgctcgaagccgaattccagcacactggcggccgttactagtggatccgagctcggtaccaagcttggccgtaatcatggtcatagctgtttcctgtgtgaaattgttatccgctcacaattccacacaacatacgagccggaagcataaagtgtaaagcctggggtgcctaatgagt

SEQ ID NO: 57 - DNA, 391 bp, Homo sapien
aggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttatttgtctagttggatttcatttcttctggaaaatttattgtttattggcatgtgacccttgactgatggcttcattagcattytgtttttctttttggatccttaatagaaaactcaat

SEQ ID NO: 58 - DNA, 455 bp, Homo sapien
gaagacatgcttacttccccttcaccttccttcatgatgtgggaagagtgctgcaacccagccctagccaacgccgcatgagagggagtgtgccgagggcttctgagaaggtttctctcacatctagaaagaagcgcttaagatgtggcagcccctcttcttcaagtggctcttgtcctgttgccctgggagttctcaaattgctgcagcagcctccacccagcctgaggatgacatcaatacacagaggaagaagagtcaggaaaagatgagagaagttacagactctcctgggcgaccccgagagcttaccattcctcagacttcttcacatggtgctaacagatttgttcctaaaagtaaagctctagaggccgtcaaattggcaatagaagccgggttccaccatattgattctgcacatgtttacaataatgaggagcaggttggactgg

SEQ ID NO: 59 - DNA, 398 bp, Homo sapien
  misc_feature (1)...(398): n = A,T,C or G
ctcagaggcagcgtgcgggtgtgctctttgtgaaattccaccatggcgtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactngntcggatcatgctaaaaggagataatattactctgctacaaagtgtctccaactagaaatgatcaatgaagtgagaaattgttgagaaggatacagtttgtttttagatgtcctttgtccaatgtgaacattt

SEQ ID NO: 60 - DNA, 532 bp, Homo sapien
gacttctgagacctggggcacccgggcctttgcggcagctactggcagggcctggccacctcataggactcagttcccttctgaacactcgggggacatgggcctctaactgcccactctgatatgcctgggtgagcctaggagggaaggctctgatttggatttctccagtcaaagctcacagaaaaaaacctggcactttgattttcatgggatggtcctaacagggtcagtcacctccgagcagtttgggaacccagtttcttgtcctgggccctcaggtcagcctggctgaattaggacccttccttggcacaggggtgagaaagagcttggggaacgcttggcattatggagggctggaaggggctcaaccccgatttggagagaagtttgggatggagtgggcgagagattgagagagcgagcaggaaaagaggtcttggagcctgggactgatggtggataaggcctggaaagaasatgacsaggaggaggagagagggaagtgggtggatgaggagcaggctga

SEQ ID NO: 61 - DNA, 466 bp, Homo sapien
gcgacggcgacgtctcttttgactaaaagacagtgtccagtgctccagcctaggagtctacggggaccgcctcccgcgccgccaccatgcccaacttctctggcaactggaaaatcatccgatcggaaaacttcgaggaattgctcaaagtgctgggggtgaatgtgatgctgaggaagattgctgtggctgcagcgtccaagccagcagtggagatcaaacaggagggagacactttctacatcaaaacctccaccaccgtgcgcaccacagagattaacttcaaggttggggaggagtttgaggagcagactgtggatgggaggccctgtaagagcctggtgaaatgggagagtgagaataaaatggtctgtgagcagaagctcctgaagggagagggccccaagacctcgtggaccagagaactgaccaacgatggggaactgatcctgaccatgacggcgga

SEQ ID NO: 62 - DNA, 548 bp, Homo sapien
ttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttc

SEQ ID NO: 63 - DNA, 547 bp, Homo sapien
tttccaaagcggagacttccgacttccttacaggatgaggctgggcattgcctgggacagcctatgtaaggccatgtgccccttgccctaacaactcactgcagtgctcttcatagacacatcttgcagcatttttcttaaggctatgcttcagtttttctttgtaagccatcacaagccatagtggtaggtttgccctttggtacagaaggtgagttaaagctggtggaaaaggcttattgcattgcattcagagtaacctgtgtgcatactctagaagagtagggaaaataatgcttgttacaattcgacctaatatgtgcattgtaaaataaatgccatatttcaaacaaaacacgtaatttttttacagtatgttttattaccttttgatatctgttgttgcaatgttagtgatgttttaaaatgtgatcgaaaatataatgcttctaagaaggaacagtagtggaatgaatgtctaaaagatctttatgtgtttatggtctgcagaaggatttttgtgatgaaaggggattttttgaaaaat

SEQ ID NO: 64 - DNA, 528 bp, Homo sapien
  misc_feature (1)...(528): n = A,T,C or G
cacctmctcccsccwggcgcttwctcsgacgccttgcccascgggccgcccgaccccctgsrccatggaccccgctcgcccsctggggmtgtygatkctgctgcttttcctgrckgaggctgcactgggcgatgctgatcargagccaacaggaaataacrcggagatctgkctcctgcccctagactackgaccctgcckggccctacttytccgytactactacgacaggyacacgcagagctgccgccwgttcctgkrckggggctgcrasggcaacrccaacwattyctacacckgkgaggmttrcgackatgctwgstggargatagaaaaagttcccaaastttgccggctgmaagtgaatgaggacnaccagggtgaggggtacacagataagtatttctttaatctaakkwccatgacatgwgaaaaattctttnncggtgggngtcaccggaccggattgagaacangtttgcagatgangctactgggatgggctcctgcrcacnaaagaaantatca

SEQ ID NO: 65 - DNA, 547 bp, Homo sapien
  misc_feature (1)...(547): n = A,T,C or G
kgaatgaasaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacagtctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaangtatcaaacagctactgaaacaagggtcagtgcagaaggtatacaatggactgcaaggatattgagagtgaataaaattggactttgtttaaaataaagtgaataagcgatatttattatctgcaaggttttttttgtg

SEQ ID NO: 66 - DNA, 535 bp, Homo sapien
ggggaggtctacgcttctagagcttgagccagcggggcgaccctgcagtggcaggactcggcaccgcgccctccaccgccggttggtggcctgcgtgacagtttcctcccgtcgacatcgaaaggaagccggacgtgggcgggcagagagcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaaga

SEQ ID NO: 67 - DNA, 527 bp, Homo sapien
atttctgccacttaattcaaacagtcatatgcaggtcgcttaatttatttgtgcttttgtttcatcttctacaaggccctcttagctctaaaacttgacagtggaataaggaaatgtttttccaaatctgcattgccggtgagatcctcaacatcagcatgttgagatggacctcaaccccacctctaaccctgaaacacactactcgatattatcttaggtatgttttagggtttagtttgtaaaataataatttatttttgaaggaaatataaaatattaaagagtaataatagctatcattttttaagattcaatctaaaacaatggactctttttttttccatttgtgatgtagataagcaagacaattttgatcatgagtggtgaaaagaggatcaaacttgactattcttgcaatggcagtccagcaacaagcctttcatttacattaaattataacttttcattcattcctaaaccaaacttaaaattctgctttcctttgagtagaaggtatttaactt

SEQ ID NO: 68 - DNA, 431 bp, Homo sapien
gggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgwtcctttagtgcaatacaataaaactctgaaattaaaact

SEQ ID NO: 69 - DNA, 399 bp, Homo sapien
gacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaraaaaaaaaa

SEQ ID NO: 70 - DNA, 479 bp, Homo sapien
cgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaatgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattaggatatttgacttaaactatctcaataaagttttgcagctttcaccaaaaaaaaaaaa

SEQ ID NO: 71 - DNA, 437 bp, Homo sapien
ctcagcggctgccaacagatcatgagccatcagctcctctggggccagctataggacaacagaactctcaccaaaggaccagacacagtgrgcaccatgggacagtgtcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttgggggg

SEQ ID NO: 72 - DNA, 561 bp, Homo sapien
ggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgac

SEQ ID NO: 73 - DNA, 916 bp, Homo sapien
ggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaa

SEQ ID NO: 74 - DNA, 547 bp, Homo sapien
agtggcattaacttttagaatttgggctggtgagattaattttttttaatatcccagctagagatatggcctttaactgacctaaagaggtgtgttgtgatttaattttttcccgttcctttttcttcagtaaacccaacaatagtctaaccttaaaaattgagttgatgtccttataggtcactacccctaaataaacctgaagcaggtgttttctcttggacatactaaaaaatacctaaaaggaagcttagatgggctgtgacacaaaaaattcaattactgtcatctaatgccagctgttaaaagtgtggccactgagcatttgattttataggaaaaaatagtatttttgagaataacatagctgtgctattgcacatctgttggaggacatcccagatttgcttatactcagtgcctgtgatattgagtttaaggatttgaggcaggggtaattattaaacatattgcttctattcttggaaaaatagaagkgtaaaatgttaataatacaaatgtcactgtgacctcctccactgagagg

SEQ ID NO: 75 - DNA, 793 bp, Homo sapien
tgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcarattgagtaattcagaaaaactcaagatttaagttaaaaagtggtttggacttgggaacaggactttatacct

SEQ ID NO: 76 - DNA, 461 bp, Homo sapien
accttgcactattcccctcagtccatctatcgaggtctttgcaggaagcatactgggaattgaaacgagagcctaaatgacatctaagaaaggcagtgttcaataccaggtattaggtgaggatgggattctaaggacatcagtgggaggcagggagccaccttcagacctcagcatggaagcttccaagatccagaggaagaggcaacagcactgagagtcataggtagaagaatcatcacagccctgctaaccaggcagctgatgcccctctcccctggctccctgtgtccaaatcctacaggggcatctgttggctgaactcaacctgaagccaaagagaagatgagtggagagaggcaacatttatagagctcaggtttctagggctggagagggatctggagggacacacaggagacacctggcataaccaaaaaatgattaaaaaaaaaaaaaaa

SEQ ID NO: 77 - DNA, 642 bp, Homo sapien
ggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaaaaaaaarawawattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaact

SEQ ID NO: 78 - DNA, 519 bp, Homo sapien
gcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaaggcgcacatgactccaaaaaaaaaaaaaaaagggcggccgccaccgcgggggagctccacttttgttccctttaatga

SEQ ID NO: 79 - DNA, 526 bp, Homo sapien
gtctggaggcggtgtcctctccgccctgtcgggtcctggatgagtacgagttatggtcacggtcacagcctgatctcttatgtgttcatagccattcgctctcccatcagaactgtttgtcctgaatgtgttcctctagttctagaaaatgaccactaatttaaaaaactcggttgtgaggtttgcccagaggcacttgttccagaatttcccctcctgcttcagccatgtccttgtcacttggcattctaagctaaagctttagcttcccaattcgtgatgtgctaggccaagattcgggagctgttgccagcctcgtcaaatatggaagagaaacaacctgcggtcaaaagggagtgatttgttaagtggtgcgcgtctatctcataactagatgtaccaaccagggaagggccaaggatggaaaggggtaacttttgtgcttccaaagtagctaagcagaagtgggggagcagtttagccagatgatctttgattaggcaaacattgagttttaaagaggctg

SEQ ID NO: 80 - DNA, 281 bp, Homo sapien
gttatattagtgggtagtgtaacattttatccaggttggggtgaggggagatggccacagtagcaagtggtgacactaaataccattttgaaggctgatgtgtatatacatcattactgtccgtagcaatgaaggatacagtactgtgttgtgggtgagtgttgctattgcccagcattaatatttgggtgtgtatgtttgaggctatgaaacacgcaggagtgtttttgtgctattaattttaagagaaagcagctttttcttaaaattcactgttgaga

SEQ ID NO: 81 - DNA, 405 bp, Homo sapien
  misc_feature (1)...(405): n = A,T,C or G
gtgggtgggagcgcgtgctgttgggagttgcttggaggttggcggcgcggggctgaaggctagcaaaccgagcgatcatgtcgcacaaacaaatttactattcggacaaatacgacsacgaggagtttgastatcgacatgtcatgctgcccaaggacatakccaasctggtccctaaaacccatctgatgtctgaatctgaatggaggaatcttggcngttcagmagantcagggatgggtccattatatgatccatganccagaacctcdcatcttgctgttccggcgscccacttaccccaanaaaccaamgaaatgaaccttggctactacttttcaatcctcaaakcttttcacavhtgaccttccttcctaacattctttmtgataaacatttattaag

SEQ ID NO: 82 - DNA, 547 bp, Homo sapien
tagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagtkgtcacagtaaatatcttgttttttctatg

SEQ ID NO: 83 - DNA, 529 bp, Homo sapien
ctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgcccggcctgaatcccatttctacagtaacag

SEQ ID NO: 84 - DNA, 527 bp, Homo sapien
cccatcaccagaatcccttcatgggagggatggatgcctgttgaaactcactgacctattggactgacgctggggtggtatcttcatcagagctattgtaagtcatccaaaaggcttctgacgaaagaacaatttttaaaaagtccctcttttcaatcaagccaatgtcctattttatttctaaaagttttgggactcgtgctgttatcaagtacaatgaaaatggctttataaatagctgttttgacattgtgatagaaggcttgaatacggaggaaagatgtcgctggagctagtcctgagttccgactgtccctgtggtgggaatccagtctgggaaagcaggactgttttagcaaacgtgtactcgttctataaaaatggaatctgttctgcaggttaccgtccctccccgcccaagcatcccctctgtcctgtctctctgctgctgggacccagggctttttcagctgcagaacccactggacttccaggaatcaaggaaaaagtggaaatgtccaactgtg

SEQ ID NO: 85 - DNA, 401 bp, Homo sapien
cagtgtggtggaattcccaagatagaaatgaaaaactcttttatagagtgctgacatctgacattgagaaattcatgcctattgtttatactcccactgtgggtctggcttgccaacaatatagtttggtgtttcggaagccaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaaaatgaggagttacttaaagatcca

SEQ ID NO: 86 - DNA, 547 bp, Homo sapien
gaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgcca

SEQ ID NO: 87 - DNA, 530 bp, Homo sapien
atggattcgaaataccagkgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacrtgggaggccatggagaagtgtaaagatgcaggattggccaagtccatcggggtgtccaacttcaaccacaggctgctggagatgatcct

SEQ ID NO: 88 - DNA, 529 bp, Homo sapien
acctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgt

SEQ ID NO: 89 - DNA, 547 bp, Homo sapien
gtttatatatatagcgaataaatctagttgtataaatttttaaatgccgtcagtagaaagcacacaaggttatgatttttttaattactggcttctgatttctttcacttctgatccttttcctttttctcagatgtagctgagtcttgatcattttaagacaacgatgggtagaattttgagattaatgttaattttccctttttgttaatttcagtcccctctcactatgcttttgtccagaaggatcaagaattctaccatcccttgggtctttgtgtataaacaatgttaaataaaggtagactcagtctttaagatattagacagtttttttagtccatgggattgtaaatataaacattaactttcctataagaatattttggctttgtaatctatagcctcaaattggtatttattatggattcactagacaaacagctgtttccttattgtcttttttctttagtgtttctgatttgctatcagtagctgtttttaaagccatccaaggaaaataattatttacagtttttgaagtcac

SEQ ID NO: 90 - DNA, 528 bp, Homo sapien
gagcagcagaagctgtacagcaagatgatcgtggggaaccacaaggacaggagccgctcctgagcctgcctccagctggctggggccaccgtgcggggtgccaacgggctcagagctggagttgccgccgccgcccccactgctgtgtcctttccagactccagggctccccgggctgctctggatcccaggactccggctttcgccgagccgcagcgggatccctgtgcacccggcgcagcctacccttggtggtctaaacggatgctgctgggtgttgcgacccaggacgagatgccttgtttcttttacaataagttgttggaggaatgccattaaagtgaactccccacctttgcacgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacat

SEQ ID NO: 91 - DNA, 547 bp, Homo sapien
atataccatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattaraccmtttggscyttgraccttymtwrgraaaawgrmccmacctttyttaacmtgraccwccytmatctctagaagctgggatggacttactatyctkgttwatattttaaatackgaaaggtgctatgcttctgttattattccaagactggagataggcagggctaaaaaggtattattatttttcctttaatgatggtgctaaaattcttcctataaaattccttaaaaataaagatggtttaatcactaccattgtgaaaacataactgttagacttcccgtttctgaaagaaagagcatcgttccaatgcttgttcactgttcctctgtc

SEQ ID NO: 92 - DNA, 527 bp, Homo sapien
  misc_feature (1)...(527): n = A,T,C or G
gctggctagtaggggaacatgtagtagccaagcccatgcattgcagtgcacagagcaacattggggtaacaggatgggtacctgtcacggcctgtgcaaacataacatgtgtcaccacactgaaggtatggtggaacaagtggcctcaccaaggtcggaccccaatggactttttgcctcttgggagcttatgggtctatgaggacacagtagcctttcctatcagcaaactggagtggatgttgtatctgggggtggccttatgtacctgctactgttctccccacattgcccagatgcctgtataactgggaggcactgkgctctcagtttttgcgaatgtgatgagccccctggtgtttctacccttttggcaatgactatccctggagncatgtgtcaaaactgtaaagcacaatttactgctctttgcggagcacaccgctcatgctctgaattacacctgaktgtccctcctccwgktawtgaatgaggttgatcnvatcagaaadgtggkgttggcmata

SEQ ID NO: 93 - DNA, 531 bp, Homo sapien
ggtattcatacagccttcctaaaggcaatgctttccacaggatttaagataccccagaaaggcatcctgataggcatccagcaatcattccggccaagattccttggtgtggctgaacaattacacaatgaaggtttcaagctgtttgccacggaagccacatcagactggctcaacgccaacaatgtccctgccaccccagtggcatggccgtctcaagaaggacagaatcccagcctctcttccatcagaaaattgattagagatggcagcattgacctagtgattaaccttcccaacaacaacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgt

SEQ ID NO: 94 - DNA, 547 bp, Homo sapien
  misc_feature (1)...(547): n = A,T,C or G
gttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtn

SEQ ID NO: 95 - DNA, 1265 bp, Homo sapien
gtggtcaagcagtgatttttctgggactgcagaagttcctgctgtgcccaacctttattactaactgggaaagacccagggagactgggatgggctcatgattctacatacagaactcatccaagaaaggaggaaaagctgatttttgtgaacgtcgctacttgtgcctgaactaactctcaggcacattagtcagaaaatactacctatggttactcccccaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctrcagcgtggggttgtggtcctggccaagagctacaatgagcagcgcatcagacagaacgtgcaggtttttgagttccagttgactgcagaggacatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccaga

SEQ ID NO: 96 - DNA, 568 bp, Homo sapien
ccagtgtggtggaattcggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttt

SEQ ID NO: 97 - DNA, 546 bp, Homo sapien
ttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgc

SEQ ID NO: 98 - DNA, 547 bp, Homo sapien
tactgggtgccaagctatgtgccaggcactttacatgtattgatttaacacttaacagccactctatattattccctttttacagatgaggcaatttaagctcaaagcatttaagtagacaaccaacctagaatcacatagcaaatgacagaagccagaggcctcccaagtctctctaactccaaaccctatgcttactctactatatcacactaccttgcaataggacaaagggaatatgtggtaaactatgttcccagcatctaaaagccaggagtggttttcatttttctttaagaagatgatagtgtgatttgaaacatatctgaatttcagaagaggggacttttaaaaattgccactcataaggaaagaaagaactttttcacatatttttgaaagaaacgatggtgagaagatattcttgataatagagatatgctaacatttgctttgggtgttttgtaggttagatttttttggtgtgtactttataggcttgcatattgcttactttaaacagctgaagttctaagtaagagtgttc

SEQ ID NO: 99 - DNA, 122 bp, Homo sapien
cagcctttctgtcatcatctccacagcccacccatcccctgagcacactaaccacctcatgcaggccccacctgccaatagtaataaagcaatgtcacttttttaaaacaaaaaaaaaaaaa

SEQ ID NO: 100 - DNA, 449 bp, Homo sapien; identical to SEQ ID NO: 10

SEQ ID NO: 101 - DNA, 131 bp, Homo sapien
ccatgttctctcttgactacgcatatgtgagatttgcccctccgccccgctcgtgatagccatccagatcttttacctggccctgtcttggagaatctgttttcaatctccactgattgcccccttgctgg

SEQ ID NO: 102 - DNA, 199 bp, Homo sapien
ctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttgaaaaaaaaaaaaaaaaaaaaaaaaaaaaaaaaaaaaaaaaaaaa

SEQ ID NO: 103 - DNA, 321 bp, Homo sapien
ttttttaggtttttaaactttttatttgcatattaaaaaaattgtgcattccaataattaaaatcatttgaacaaaaaaaaatggcactctgattaaactgcattacagcctgcaggacaccttgggccagcttggttttactctagatttcactgtcgtcccacccccacttctttcaccccactttttccttcaccaacatgcaaagtctttccttccctgccacccagataatatagacagatgggaaaggcaggcgcggccttcgttgtcagtagttctttgatgtgaaaggggcagcacagtcatttaaacttgat

SEQ ID NO: 104 - DNA, 309 bp, Homo sapien
tttttttttttttttatttttttttttgcatcaaaaaactttatttccatttggcccaaggcttgttaggatagttaaaaaagctgcctattggctggagggagaggcttaggcaaaacccctattactttgcaaggggcccttcaaaagtctctgggcttctatttcaaccgcgatgatgtggctctggaaggcgtgagccactttttccgggaactggccaaggaaaagcccgagggctacaaccgtttcctgaaaatgcaaaaccagcggggcggccgcgctcttttccaggacatcaaaaagcca

SEQ ID NO: 105 - DNA, 591 bp, Homo sapien
cttatttctgcatgggtcggagagtgggcgggactgctttactgagttatagtgaatgtagttttaacctaagcgcctcacatgactaactcctcatccatcaagaatgagctcagctctcacttccccactcctcacccccctgtaaagtaacctttctccaaggttatgcttcaacaggaatagctaacatttattaaattgtggcacgtaagtatcttggatatattggctcattgaatcctcacacctactattttacagagatgccagtggggcttgagattgaatcacttgcccaggctcccactgctggtaaacagtagagggggctcctgacccatcagtctggcttgacaacccattccctcaactgcggatcccggattcccttatcaccctgttgatttctccataggctgtggtaacatttgttgcatgaatggaccgttgaaatagggcctggcagggagaaattcaggaaatgaatgaatggttcttccctggcagcctttgatgacttacaagccccttcaagggggaaagccatttttctccctgggactccttgaaagcccgggagccctgcct

SEQ ID NO: 106 - DNA, 450 bp, Homo sapien
ctgccactcctgcctctgctaccccgaaaccggagagggagctcaataataacacaggtcccactaaactaattaaggtgttggcataacctgtcattgaattcaagtgtccaacaactgtttgcttaaaatatcattagacctaatatttttttcaaaggcacaaagtttaaacatggggggggcgggtgttgagaggggtctgggatacccttaaacccaaaaaagtgatttgttcccccttgcccagaagggtgactgttccactgggcctgtcaccacaggacattttccatgacaagcactcaccttcttggggaaggggcatcaggttggcacaggaaaggcccaagtgaggggccactctgtacattaatactttggtgattaatgtttggggagaggcaggattctcacccacctttttgacttcaaacactctcactcaag

SEQ ID NO: 107 - DNA, 116 bp, Homo sapien
tcgacgaaagttactgtcactcagttgtaaatccatcagcttttcacctgttaaaaattttgcaaaatatacatgttctcctcctgttttcaattcttccatcttttttcttgagg

SEQ ID NO: 108 - DNA, 291 bp, Homo sapien
ctgctcgaagttgtcaaaacccacgtgcagggcaatggagagtccgatggccgaccacagcgagtagcgtcctcccacccaatcccagaactcgaacatgttttgagggtcaattccaaactccttcactttggttgtgttagtagacagggcaacaaagtgcttcgccactgcagtaggatccttggccgcctggagaaaccactccttcgccgtctctgcattcgtgatggtctcctgggtagtaaaggtcttggaggcaatgatgaacagggaggactcggggttcag

SEQ ID NO: 109 - DNA, 662 bp, Homo sapien
gctgtttccacagtacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaaagacagctcctggaccttgccccggggcggcccgctcggaaagggggcgaaatttcttcaagaatatttccatttccacaaacttggggccgggggccc

SEQ ID NO: 110 - DNA, 323 bp, Homo sapien
tcctgtgaaacagcccattttcctacctactgtgggttgctgctcaggaggaacgatatacgccaatacaagcaggaaatctgcagctcctctgctatgtgcctcagaacactttcaatttttctggtcaatgctctgattaggtatcatacataaaagccagcatattagtttaaatctctaacaaaaaactatattttccaaagtcattatcatttgggccaattaagtgatcttttcgtgctttgttgagcttcatctttagggcatctcttctttcttcccattcatgaagttcggcatttccatgtgcaaatttacag

SEQ ID NO: 111 - DNA, 336 bp, Homo sapien
tccagtgcgctccagccttatctaggaaaggaggagtgggtgtagccgtgcagcaagattggggcctcccccatcccagcttctccaccatcccagcaagtcaggatatcagacagtcctcccctgaccctcccccttgtagatatcaattcctaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtgg

SEQ ID NO: 112 - DNA, 218 bp, Homo sapien
tttttttttttttttttttttccagtcaggagtatttttaatcactgtctacagagacacctacatacacacacgggtggggaatgaacccaaagtttttaggtgaagtctctcagggcccaccccgtgccacagaccttcctcggttgcagagattctgggcaaagcatccgtgctctcatgagattatcctggggagatttagaagaattttgtgg

SEQ ID NO: 113 - DNA, 533 bp, Homo sapien
ctgcaccgacagttgcgatgaaagttctaatctcttccctcctcctgttgctgccactaatgctgatgtccatggtctctagcagcctgaatccaggggtcgccagaggccacagggaccgaggccaggcttctaggagatggctccagaaaggcggccaagaatgtgagtgcaaagattggttcctgagagccccgagaagaaaattcatgacagtgtctgggctgccaaagaagcagtgcccctgtgatcatttcaagggcaatgtgaagaaaacaagacaccaaaggcaccacagaaagccaaacaagcatcccagagcctgccagcaatttctcaaacaatgtcagctaagaagctttgctctgcctttgtaggagctctgagcgcccactcttccaattaaacattctcagccaagaagacagtgagcacacctaccagacactcttcttctcccacctcactctcccactgtacccacccctaaatcattccagtgctctcaaaaagcatgtttttcaagatctaaa

SEQ ID NO: 114 - DNA, 261 bp, Homo sapien
  misc_feature (1)...(261): n = A,T,C or G
ccatatctgctcggcgctacttctttcttggattgatcctgantgatgcattggcgatgcctttggagaaggacatgtgatgtgatggtcttcacgttccacatgtactcgggcaaatagggggacaaactgaagttaaacaggtcgaaactagaggagctgctgaccctggagctgaccactttcttggggaaaaggacacatgaaggtgctttgcaaaagctgatgagcaatctggacaccaacataggacaacaacgt

SEQ ID NO: 115 - DNA, 267 bp, Homo sapien
cctctcctgtgggttccagaccctgttccagcaacaattgctgggacacctgggccgactgctccacctcgccaggccctggccctctccatctcagccctgacagccacccagtgataaacacagcaggcttcctaagcaatgtgacgcaccagaggggtggtggtacacgttccccttgaagtcatctgaaaattagagaacagatttgcctcatagctgaagagagaccctattccaagcatgaatggccttgacaatgttcct

SEQ ID NO: 116 - DNA, 239 bp, Homo sapien
ctgatgacctggggtctagtgaaaatgcagggtcagattcagtgggtctggggtctgaatctctaaggcgctgccaagtgatgctgatgctcctggcttgtggaccaccctgtgtatagcaaagctctagactaggaggtctcaaccttggctgcacagaattatctggggagtttttaaatttcccagtgcccaggctgcattcatatcatagtagagacagggttttgccatgctgg

SEQ ID NO: 117 - DNA, 168 bp, Homo sapien
aaaaaacttttatattgctgcatcttccacagttctttgggtagtctctgaacttaaaatttgtaggagttgtagactacctaaatttttaagttatggatttgttcataggttgtaggggtaggtaaagaaggaaacagacaagaaaatggcttcttgaggtggcag

SEQ ID NO: 118 - DNA, 150 bp, Homo sapien
aaaaaaaagagtttatttagaaagtatcatagtgtaaacaaacaaattgtaccactttgattttcttggaatacaagactcgtgatgcaaagctgaagtgtgtgtacaagactcttgacagttgtgcttctctaggaggttgggtttttt

SEQ ID NO: 119 - DNA, 154 bp, Homo sapien
aaactgtgtgagatattaaccagccgccctgttataaaatcaggaaatccaaacagcgatttacaccgattaacacccccttttatattttttcaaatacactgagaaaataatcaaacgttttcatctctcttgtctttttttgttttttcct

SEQ ID NO: 120 - DNA, 314 bp, Homo sapien
ctgcgtggagtgacgggaggagggaatcactgtgtgtgcgagagtgcttcagactcaatttccaaaataattttcacccctctaagcatgtaaattcaaagatggatccttcatagaaattaaaaaatcaatttgagctcatttcgaatacagaacaagtatggcacagatggaagtcctgccacgtttcctttaatgatgctgactcttgtatcacacaggccagcatgaagtttcttactcagactttacaggcattttccgtaattcaatcagtcctgctcccagcacaacacaggaggtgattcgagaat

SEQ ID NO: 121 - DNA, 601 bp, Homo sapien
aaaaaaaacctaattcattgaagtaataaccaaataattttcaatcttgattcaactgtgattcaaatcttacaccatttgccccttctatgaatttatgtataaaattttttaagagtcagagtttttttttcttgattaattggatgtatttcacagaatttccaactgctcacgttagttttcttccttttagagttgatctctctaatgtattagatcttcatgcctttgatagtctctctggaataagtttgcagaaaaaacttcagcatgtgccaggaacacaacctcaccttgatcagagtattgtacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaacgacaaatcacaacaagtgattgtccagggtgtccatgagctctgtgatctggaggagactccagtgagctggaaggatgacactgagagaacaaatcgattggtcctcattggcagaaatttagataaggatatccttaaacag

SEQ ID NO: 122 - DNA, 486 bp, Homo sapien
ctgtttctaattgcttttgtgactgttaccttttagttcatgcccccccaaagagctaaatttcacatttttacctacaaaattgatttttaattcctgcaaataatttaccattatgagctacaaggtgggcaacagcgcctgaggatctaattttatgcatattactcccaagtattttaacacttgttggagaagcaatatctggatcaataaaacactgtcccatcaaccatttgagtggggagagggagaagctcttctgtaagtaagattctggcaagctctttgaaatgagtcttctttcccacagattttctctactctttcaatacaaacagataggagaagagggaatagaaacctggaggaacttgaatatttttgttctagatagagatacagttattgaaaaggaaacctagaaagtagtcacacgtcgcttatttaggccagaagtaattgtactgggcaaaaatttcactt

SEQ ID NO: 123 - DNA, 239 bp, Homo sapien
ctggtgggtctttttttcctctcagagctcaagcctgtagtgcctgatgtcatttctttcaagttgcccacagtatctccacttaaactaggctagtaaccaaaataatgtggaccttctttaggaaacagtgtgggagaataggagtccagccgtaagataaactggaaatatttgggcgtcttgtacctggctacgcaccacctcagtgttgttcctacataaacaaggcccctttt

SEQ ID NO: 124 - DNA, 610 bp, Homo sapien
  misc_feature (1)...(610): n = A,T,C or G
ccanccaagtcnttgatgatcactgacccncgcgcgcctgctggaccaaggtggctgcggggaaatcgccacngngctttcggttttcttggtgaaggaatacaccgcgccgacagcaggttttcagtcagggtcagggactgttgcttgcgcgcgaaaatcaccggtacgccgaggttcaggccggtcatgatcgccggtgcaatgcccgaggcttcgatggtgacgatcttggtgatgcccgaatccttgaacaacgcagcgaattcatcaccgatcagtttcatcagcgccgggtcgatctggtggttcagaaaggcgtcgaccttgagtacctgatcggaaagcacgatgccttcttcgcgaattttcttgtgcagtgcttccacgaaagcttcctctgttggcgcaacacgcgccgaaagtagattaaaaagtagtcgattctagcgctttaacatcgcgcgtatatccgccagggcggtattgccgcgaacggctttgacttcggttggtgtgtcgtcgttgccttcccatgccaggtcatccggcggcagttcgtcaaggaaccggctgggggcacaatcaatgatctcgccgtactgcttgc

SEQ ID NO: 125 - DNA, 196 bp, Homo sapien
ctatagggctcgagcggccgcccgggcaggtaaaaaatcagcccctaatttctccatgtttacacttcaatctgcaggcttcttaaagtgacagtatccttaacctgccaccagtgtccaccctccggcccccgtcttgtaaaaaggggaggagaattagccaaacactgtaagcttttaagaagaacaaagtttt

SEQ ID NO: 126 - DNA, 247 bp, Homo sapien
aaattagttaaaaaaatgcattcctcatttgatatagccacattccaaatgcttaaaagccgcatgtatctagtgactaccatactggagagtacaaatatagaactttacccgtcactgcagacagttctgttggattgtgcagcattggacaatatatacagtttgcctgtatatgagaaagagagagagagagagagtgtgtgtgtgtgtgtgtgtgtgaagtgcaataaggctgacaggcatc

SEQ ID NO: 127 - DNA, 590 bp, Homo sapien
cctccacggcatggcgcaattgttgttcaggggccgccaggttgctgcccatgccgatgtagatacgttccacgtgcttactcgccagacgcactcgaagcgtcgccagcgctacgtttgcgcttgctgccactgctgcggcgacgctttttcgggccatcgccggtggcttcgcctttgctgctgagctctttgatcatctcgcggcgctggctgtcgttggcgtcctggtagtcggtccaccactcgccaaggccgtcggtctgttcgccggcgctttcacgcagcagcaggaagtcatagcccggcacggaagcgcgggttgtccagcaacaggtcggcacgtttgccgctgcggcgtggcaggcgctcctgcatgtcccagatttcacggatcggcatggtgaagcgtttcgggatggcgatgcgctggcattgctcggcgatcagctcgtgagcagcttcctgcatggctggaattgccggcatgccacggtcttgcaggcgcatgacgcgtttcgaaagcgcgggccacaacagggcggcaaagaggaacgccggggtgaccggtttgttctgcttgatgcgca

SEQ ID NO: 128 - DNA, 361 bp, Homo sapien
ctgcccatggaaaccctccaggagctgctggacctgcacaggaccagtgagagggaggccattgaagtcttcatgaaaaactctttcaaggatgtaaccaaagtttccagaaagaattggagactctactagatgcaaaacagaatgacatttgtaaacggaacctggaagcatcctcggattattgctcggctttacttaaggatatttttggtcccctagaagaagcagtgaagcagggaatttattctaagccaggaggccataatctcttcattcagaaaacagaagaactgaaggcaaagtactatcgggagcctcggaaaggaatacaggctgaagaagttctgcagaaatattt

SEQ ID NO: 129 - DNA, 546 bp, Homo sapien
aaaaatacaaattcagtaagacttttgctctaacaacaatttttcaaaacgaatcaacaacaaaaaagtatccagtgtttcttttcttatgaagatataataaaacacagtattggtaagcacattttaacagtatgcttttcttttgtagggaaaggagatatggctatgtctaacatcgtgggatccaatgtgtttgatatgttgtgccttggtattccatggtttattaaaactgcatttataaatggatcagctcctgcagaagtaaacagcagaggactaacttacataaccatctctctcaacatttcaattatttttctttttttagcagttcacttcaatggctggaaactagacagaaagttgggaatagtctgcctattatcatacttggggcttgctacattatcagttctatatgaacttggaattattggaaataataaaataaggggctgtggaggttgatattattaatagtgttatgcagaaaatatgaatggcagggaggggcagagagaaaaatccatttcttcattt

SEQ ID NO: 130 - DNA, 733 bp, Homo sapien
  misc_feature (1)...(733): n = A,T,C or G
ggggcctcttcctaaaggcactaatcccatccaatagggcttaacctcatgacttaatcaactttcaaagacaccacatcctaatgccatcacatcagaatttaggcttcaacatatgaattttggggggacacaaacattcacctcatagcattcattgtttcttgttattggcaaagccaagactcacattgtctaagttatttgacttttgagtccgcagatgtgaaaacagtgctaaacagtccagcttcatgagtggagaacagcatttgtgacaaccaccaaagtacctctgtggtcagtgtcctcaaccagggcacagcatcatggaccagagcctctgcagggcacagaggagtggtgaggaacaggggctctggagcaaccccacttccctctgctttgtatatggggggttctgcacatgactgcatttgaaaagggcttcactgcgcttgctgaaggagtgcacttgagctagcggagagttcccagagggtgtctggaagaagcaaaggctattctttgtttcactcagttatagatggaagtcagacacttctgcctgaagtactttcacacactccacagtcttaagaaggatgganaaagcatgccaactactcanaaaaccacaggtgttcaagcaatggtatccttttatncctacaactagtggacaaagnggggcctctgtaatttgggaaagctaggaaaactttttctgggg

SEQ ID NO: 131 - DNA, 305 bp, Homo sapien
  misc_feature (1)...(305): n = A,T,C or G
aaacacatacgaatanttnaactgtgattatgaagtgacagccggctaaatatgtcttgtattttctctcttcctttttttgctaactcatcctttattccattcctgcttccatggtaatgcaggctcaaataaattactaggatacaagattacttcaagcctcttttctgtggaactcataatatgataagcatttgttacaagattgcctgtagttgtttaggggacaaattatattagggaaagaaagtctttctttagttggttaaattttctattataattgggtactaaatttattt

SEQ ID NO: 132 - DNA, 545 bp, Homo sapien
aaacaatgctacactcatttttggcaaagtgctgtattgttcagtctgtgtacaaaactgaccatctatgaaccaatcagtataaaaaatttctataaaaacaaaatttagacagcggctcaagaaaacaagctgccatttatgcatagattgatgtacagtaacctaaccaaatgtcccttttgaattttcaagttactgaaaaaaaatgtgtcgagaaacacattaagaaggcacatgtacagtctacaatactcttcagtctccctaactcatgccctgcccctataaaggaaatatgttcacaattttacttgagaaaaaaaaacaaagccacttaaaaaaaaaaaaacacacacgcaattattaaagttcaaaatctctggaggaaaatacaagcaaaaccactcatacactccaagcctgaaacacacatctaacctccccaggtactggtttggttttcagaggtccacctagaaaacaaatctaaaacttcaggcaaaacagagcaaaactggacatttaacaattacacaattttt

SEQ ID NO: 133 - DNA, 330 bp, Homo sapien
  misc_feature (1)...(330): n = A,T,C or G
aatatttattactaatatcttataatgttttgtggnaccatggcataccttgggtactattgtaacanatagttcaggaaaccctactataaggtttatcaaatggtctcataaacagttacttattcaagcacgccaaagctcagtgaaaagtatttttcacccttactctttctcgtgtcattcaaagagaagttttgatgtagtgtatttatttgtagggagtaatgaacagatccatttcacagtagactttgtgctctaggtgatgcagctaattgccccagtttggaaaacatggacttggatgaattgtcttttgtttgggac

SEQ ID NO: 134 - DNA, 627 bp, Homo sapien
  misc_feature (1)...(627): n = A,T,C or G
aaatattacttcaaatacattttaaagctcaacaaacttgtgttgaactgaattgcagatcctgaactctatttgaaaatacatcatgaaacagaaaancccattccaaatgaaaatgatagtgctttgttgggggtgggaatgaggcggggagactaaatcactattaacagacttcttttcccaatgcaatttgtcaaaagttcaaaagttctgaaatgtactaaatcttaagcaaattaaattcatgatattactaaaactttttaaatagtgcaatgacttatcaagttatagtggctgcattaagaacaaattattgtgtgaaatacctgtataaacacaaaatacaattaaatatttctttacaaaaagctgagcattacgcataatagtggaatgtctttcattaggtgtattttttaaagattaacaaaagtaacatttcctaaaatgtatacatgtgccatatttttgcaaacatgcctgagaatgtatttaaaacatttctgtagtaagagtttgcaagaacttcacaaacctgcaaataaaatgcatctttttaaaaaggtgaaaatggcatctccacactgcaacaattcaaaaagtgcagcatccctaatcttt

SEQ ID NO: 135 - DNA, 277 bp, Homo sapien
  misc_feature (1)...(277): n = A,T,C or G
aaaatcaaatatattatttgttaaaaatcagcttgtttcattacnggaaattacaccagtccgttctatttactttcaaaccatattcaactcctcaactttcaaacatgtaatcaactaatttcaaaagggaaaaggtaccctttataaaggagagatctgttaagacaccaagaaatcaaaattaatatcacttaataattaagtggataacacatgcctcccaatacagtgcagtgagaaacacaaaacatcaattcccgcgtactctgcgttg

SEQ ID NO: 136 - DNA, 486 bp, Homo sapien
aaaacagaatgaattcattgttacagttacagaagtcagaagcccaaatacagtctgcctgaaccaaagccagggtcagcaaggttcctttccactgttttgccaacttctagaggccacctgtattccttggttcatggcccctctcttcatcatcaaataatcagcatagctttatgacattggcagctctgattttgctcttttgccttcctcttatgtagacccttgtaattacattgggtacacccagataaccccaaataatctccctatctcaagattcttaatgtaattatattgggaaagtcccttttgtcatataagataacatagcaatggattccaaggattagtatgtgagtttcttttgaggggctataattaaccctaccacaatatggaaatgtctattgtttttctatgtaccagaaataagacattaggatgtgaaattaataacataacaccacttacggcatcacc

SEQ ID NO: 137 - DNA, 552 bp, Homo sapien
  misc_feature (1)...(552): n = A,T,C or G
ccatcttgcatcaaatgttcttaaggcagtgactggctatcaaccacagtttctgtctccccagttgcaaacacaggatccatgcaacagttctgagaccatacacttagaaaccacaggggatgcggatcaaatgcagaactcccaaattataaaacagtcaggctacactcaaaacaaaacatagaacatcaacaacacacatctcccaaaaaagaagtgcaacgcatgcttgtataaaccaacaataacaaaaaaaccacaataaaaaatgcagagtctcccaaacaagttttcaaatgtattgcanaaagaaaaaaaatgtatatatatataaaattaaaaagtctgaaatactagtgcatagtcaattacctaacaccaagtttcttttctttctgtccaagctctactgcccctctgatactagcagcatgtctacaggctaagaccatagcagcaaaaaacgtttttcatttggcatttacaaaattaaattactgaataaaaatataattttttataaaactatttcttacagtaataattttt

SEQ ID NO: 138 - DNA, 231 bp, Homo sapien
aaattttactagtgttacttaatgtatattctaaaaagagaatgcagtaactaatgccctaaatgtttgatctctgtttgtcattactttttcaaaatatttttttctgtaaagtataatatataaaacttcttgcttaaattgaatttctatattagtggttaattgcagtttattaaagggatcattatcagtaatttcatagcaactgttctagtgttttgtgttttt

SEQ ID NO: 139 - DNA, 535 bp, Homo sapien
cagttgccaaccctctgaaccgtttaggccggttcatcgctgcctttgaatctgggccggtggtgatccggcaaggggtgaaaccaaagagcgggggctgtgaggcccttcgcagtccctcgtaagtcgctgcgatggagtgaactatcacgcatcgtgtttatttcgtcaacacgaaatgtgatttatttttgcgaattaacacggcagttctcggttacgttttcggaaagcgtgggatatgattctgtctatcctgtacggatatacagtaattaccgggaggggattccatggcgaagaagcaggcggcaccggcagcacggcaggaaatgagcggtatggcgcgcctcgggcttcgcgtctcatcgatgattaatcacccggtcgcccagacgcagcgctgggttacgattcatcgcctggacacggatggggatcgggagtgggaagaggttctgagcgtgatcgctgataccgacgagctcgagctgacgctcaatgacgatggcagtgtgacggtgaggtgggagca

SEQ ID NO: 140 - DNA, 640 bp, Homo sapien
  misc_feature (1)...(640): n = A,T,C or G
acattggtggcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatggtgacaagagtcaacaagagcgtgactgggttctaaatgaattcaaacatggaaaagctcctattctgattgctacagatgtggcctccagagggctaggttagtacaaactcgcattcatggcttggtttcccagaagatctccatttaacttttttaaagaaagtttattgctttctttaacctgcattttttctaagttttttttcgcataaaggtgctgtctttgtggcaaggcctaggcatgacaatcggaggactcgagggggatggaggactagtgatccggctggctgcttccagtcgattagagaggtgaaaaagctgaacgtgtgcccantnaatcttcaaaaaggcagaaacatatcaccttntgcccccntaaacttgttctttttccgaaggggaaaaaaaaaatggaaa

SEQ ID NO: 141 - DNA, 127 bp, Homo sapien
aaaaatcacacactgacaacacagaaatacgaaatgctaggaaaagtctagcatatgaaggaaaaacatgtcttatgcactctaatataattttttcaattagtataaaggcaaatgcggttttttt

SEQ ID NO: 142 - DNA, 126 bp, Homo sapien
  misc_feature (1)...(126): n = A,T,C or G
aaatatcctctggatgcnttcaagtaatactaatcatttcatgngnaaaagtcttttaataaacaaattcagagtaaaattaattgaaatatttataatacatttgttacacagttatttccaata

SEQ ID NO: 143 - DNA, 730 bp, Homo sapien
  misc_feature (1)...(730): n = A,T,C or G
gcaagttctggagtgttcacttctgagcctgaattccctcccctgcaaaatgggggaataccctcctcagagggtccctgcgagggtgaggggagatcagcatggcaggtgtgctgggcacggcagggcctgggaagggcagatcctttccccatccctgccacaaacaacccaaacctttaaaggagagcaatggccttgtgtcaaaaacaaaaacaaaacaaaaccctgtcctaggagactggggccctaatttctaatagcaagcctttatgagtccctaacactctactgggctgagtatctcacacgccagaggataacctgccttctgctcaccaccaccccgtagtagttgtcattgtgtccatttcacagatgaggcaaaggctcagaagagtcatgtgttaaaccagcttctagagcccatgcaggagctgcaggtggggagaatcacctctaggtgctcttcccatggaatcctcaccctccttgagtggtcactcactcanctttccaatgggtgtgtgacctttgaccagctttctttccttntctgggcctcagtttcccaccttggacaaagtaagaggtctcttgggnttcanggtagttcttcctaacttcttttccttttcatttgagcatccttcttcattttttgccacctctcttgtcattacangcttttaccttcggccgcgaaccacgcttaagggcnaaatttcca

SEQ ID NO: 144 - DNA, 485 bp, Homo sapien
ctggtcagaaatgattctcttgtgacaccatcgccacaacaggctcgggtctgtcctccccatatgttacctgaagatggagctacctttcctctgtgtggcattttgtcgcttatccagtcttctactcgtagggcataccagcagatcttggatgtgctggatgaaaatcacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctgcaacttctggaagaggagaacaaagaacgtgctaaaagagaaatggtcatgtattcaattactgtagctttctggctgcttaatagctggctctggtttcgccgctagaggtaacatcagccctcaaaaatattgtctcaacag

SEQ ID NO: 145 - DNA, 465 bp, Homo sapien
ccaagacagctcgtttctggagagtatgagggtgtgttttcttattgtgaaaggaactaccttctcttagagggtaggaagaatgtggtgtgtgtgtgtctcataaagcaaccggacattataggtgcccaggtcatctataaaaacgatccttgggctgtgtaaaaatgaagtggcttttcagtatcctctttcacacttgctgcttcgggagactatgcaatgatgggaaggtgattgcccctttatttcattcagtgccatggtccctgttgttgtagtaatttatttgtttagttcattttttttttcttaacagtcaaggggaagagtgattcctcacactgctttcaagctggactgagccagtctcattctgggaaagaaatgctgtgtccagaactcagcagctccatctattttttccagtcgaaagaaactgatctttaggcagtttttacttgg

SEQ ID NO: 146 - DNA, 351 bp, Homo sapien
ccagccggggtaatctgtatgtggcggacttgagctacgacgtgggcggcaagtgcctgtttgaccagatcagcggcgtgaagcttatgccaactcatcgtttgataaatccgaggatcagttcaagacgtcgcagcgggtgattttgggaacgtcgttttcggtcagtaaattgtgggtagcgacggagtggttgatcggcaagaatgatccgtatattggcgggagcagctataccgagagcctgggggctggggggagtaaccagtgggagaatcagttatatatgaacattgggtactacttctgacttaagatctccagcgttttaactggccttatcgcaggcaa

SEQ ID NO: 147 - DNA, 654 bp, Homo sapien
acttatttttaattactgaatatttcttagacgttttgggacagattttatgtaatctttataagtatgatttctgaagaaaagcaaatgcattagtatgtttgccttaaacttgtagactaaaccaagtattgtaaaataaacagcgataacagtgatagtttttaactctatggtcattgtatcactctggaaaatgtggagtagctgtaataaatctactcctgtattatgctttacagtgcaggtcttagtttttcttttttctcatttcttttgaaatggcatctcgaacaaagtccaccaatccctttacaaaagaatgaactgctcctctgtgtgtacttcatagaaggtggaatcggacagaggcaggttagtgacagttattcctgaaatacaggagcagagtacagtctgttgtggtttcccggattccgcgcctagctcagccaattaagcatgagacataggccattgagccacttagtagttatgcgagtggatagattggtatgtaagagggaaagaggtctgctgtaaagaacaacacttgtttgtctgtggggaaagaaaagcagaatcttgagatgaaagttggcatacaaataggatactatcgccagtaggttatattacaaaacatttatcggg

SEQ ID NO: 148 - DNA, 539 bp, Homo sapien
tgaatatcatgagggtgattttcacctgattgcaaaactgccatagtttgaaacactttttcaatttaccagacacactctgtcaagacttcatatacttccaacttgcaagcctgtgttttgccttctccaacctaaaaaggaaaagctttaaacgatgaacttacattctattaaaccatcagacttgagcttatccatctgtttagcgtgaatgtacaaaccaggtacatttccaccaaacacatagaaaaatcttgtgcatcacagttcagctaagggtagtaggacaatccttacaatcctccttggatttcttttttaagatgtcaaagaagcaggtaagcaacattgttcatttgttactgggtgttctagatcaaaccttcacaagctatatatatagcttcatatgctatagcttacaaatggggtaacaaagtaaaagaaaagaacaaattatactttgacactttatagtcaaagtataattaaaaaagaaatcctacagtgggtaatggagaaatagataatttttc

SEQ ID NO: 149 - DNA, 273 bp, Homo sapien
tttttggtcattctcctcaaggagccgctggatagtagtcttgattgacttccaccttgcccctcatacagtccggtactaaggccaccgacatcccgaggaacctccggaaccacgaccgccaagcaactcgacccacgataggtggggcctacgctctcgaagttgattggatgctcccgcctacagggcggggtacagaagggacgtcatttgtgactggacgcgcaagagctatactcagcagctttcctctgtcccagcccctagaac

SEQ ID NO: 150 - DNA, 200 bp, Homo sapien
gtttttactaccgtatggcccatttaaaagggatgtgtacgccttacactataacccttaaaccacctagaaatatgaaactcaaactgccactgacctccctcaccaagctccataaaagtaaaaaattataacaaaccttattaaccaaactgaacgaacatatgggcgattgattcattgcccccacaatcctaggg

SEQ ID NO: 151 - DNA, 515 bp, Homo sapien
ctgtagcgatctttaagaatattttatatatgaaatctggatttagggttcccatggtctggcaccactgggtacagtagttctacatggcagtaattcattggagttgaagcagtgaggaaagagtcaagtactagtcttttatcctcagtgtccagtgactgtcaagagaaatgggactgccttctgcattgggatatgtgggttaaagagtagtccaatatagaagagtgagaaagtgmaccctctgaggcatagtaatgttttattkraaaacatctcacatgtattgaatacttasataggatgtattctgtattactgaattttccagattattgaagcaatcacctttctgtgtttaaagttttagaaagaatgcttttaaaaatgcttaacataagataagcctgttttcatggtgcaaggtcctttctatgaacatgaatcactggactctgagggttggactaagatcacatctacatcccttttaaatgactagtgtgctcaga

SEQ ID NO: 152 - DNA, 243 bp, Homo sapien
atttcaacaacatacttgtcgaggtagttataaatcttcttagggggaggtggtggtttctgttggaatgccaattttacagcttctgctgctgattcaggttctttaattatgcttttctttgagtctgcttcagatagcacaacaaaaaaatgatgacacttttcacacttgacaaaacgggtggatgatacaaaaggtctctacatgtgtgcacaagtcgccacatttaggacagcgcag

SEQ ID NO: 153 - DNA, 620 bp, Homo sapien
ttgtcttctctaccttaccatagccagttgctttcattttaaaccagagcaagtaacatattagtgacttgaatcttcataagttaaagtaaaaaacagcaaaaaacctagatctttgtcttttagaacacagaccattttcaggaaagcagttagctaagtgtttaattcatgaatattgtatactgcatcccctaccacaatttacacaatcctgtggatagtcctacctcaccctggtcaacctacatgatccttaagctaatggcggatcacgatgaccttgtagacatgcacacaactatacctttgtccaacagatcataatatatctgctatccaactggttttacctgcctaatcctactgatttgggcactgcttgtatagtctctcaagttcacaggaaatgttgattttctaaggtcctcatttttacagagtatacaggcaaagtgacaggggaaaaggaattagtctaagagtaaggggatgattattatattgaggctaaaaccacaaagtggctcaggctttaaaaaaaaacactgtggataatgacaaaaagcataagtaaaaatattttgagaaaaataaagtacaagttttgaacacccccc

SEQ ID NO: 154 - DNA, 843 bp, Homo sapien
cattgttagtgacccaagtaaatttatagtttttaagttcagaggaaaaataaagcctattttttgttaacagtcttaataaataataaaatggaataaagaaaccaaaaaaaaaagaaaaagtttgtatgaaaattcatccctatttctttattttggactaagtagtcaaatttctactatattaatattatgtaagcgacacccatttaaattcactctctttgatagaaaggtgagttgattatcacacctgctattttttcactgccaaaragactgcaataacctccctccatcaccctcaaaaaacaaacagaaaccatctgaggcatagccattgtttacatattgtgtttgtgtgcacctatctacaacgttctttcttctaaggagtttatctgccaatattttcggcttcagcagcagcgctcttcttgacagactaagagaaggatctacagaaaagtcatctgattaaggttttgggtcaaattaaaactctctggacagaatcctctttccttcacttggatttctgcaaacagaaagcagattattctcctggcacaatagcgactctagaaacgcttatgtttttcagactttggcagaacttgttaagaacagcatcatcataatacatttgtacaaactcgaatttcagtggctcttttgtcccacatgatgcatgatgaaatttataaaggtctgttttacccccacagggtcatttcttttgtgttcctacagagccaataggcttcatttaagtccaagttattatattaaccatccctttcactagactagagaacttctttttcatggtccatatcgtga

SEQ ID NO: 155 - DNA, 674 bp, Homo sapien
tttcgtgtcagccccaggtttgctccagctattcacaagcagaatataacacaagaaaaacaattcatatcccttagggaaaaaagaggatcaattcatcactcaatatttaatacagccaaaatgagctgccaaaacaagcacacacacaaatactgtgaacagaaaaatacaagaaaatgactaagctgggagtcttgacggggtatggacattgcttaaagcacttatcagtccccagaaaaaccaaaccaaaaacattttttacgatggcatggcctcatggccccctttaaaactgttgatggtaacaaagggcagggggtggggagagaaaacacaatcactgctccctttttgctcgccagtgtgactgcacccctcacggcaccggcatgtacacaactaccacacaaggaggaccaagtccctctgctggtggcctcctaaaaggcaaggcttgagttttggctgatgagcaagttctctccgttaccaatccctgccaaccagcactaccatggctgaattgatctaccgttttcctgagtaaactgtaactggctacagtttcggtaacatggaaaagaactcagctactacagccaactgcaatacttcaggaaccccctccatccctggggctcctcactcctagtgcatcttgattggat

SEQ ID NO: 156 - DNA, 671 bp, Homo sapien
cctttagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtgggctggggcacaacttttagtctgaggggagctagtagtcggcttgacaattaaagccatccataacaacttttcctcaaatgtgttgactcctcaggggctaaactgctcttagcttagaattatgctttactagagatctaccatataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacattttgcagaattgcagattttccc

SEQ ID NO: 157 - DNA, 474 bp, Homo sapien
cgcgttctttaattctttaagcctagaaagtcctttacactacttacctaaaggtcccaaagtaaaacacacactagtagtaaggctagtgcatttcccttctagcactcaaagaaagcttaacatttttgacagtttgcaaataccgccttgtatttctgattcagccttattcaaagtatcataataaaatatttattaaatstatgttgatctgcgtgcatttatgatctccagattaacgttaggcttctctgttgggccctaacttggaggtgcttttttggatccctcctcccgtgattcattgtaatttcatttcccttgtcatggctctgaccagagaagattctaaatatctgcccccaaagccaaaattatatcttttgaaaagtgaaatgaagagttgagtcastaatttattttagatattactgcctaaaacaattccccaaaatttatggaagttggagg

SEQ ID NO: 158 - DNA, 584 bp, Homo sapien
ttggattctgcagttccacatcattcactccggcaaaggagagaacttgtaacaaagatgagtgccaagtttagtcaatttaccctacctggaatactatatacaactctgggtctcatgtgtgttaaaatacatacagtgaagctgaggaagagccactgaagtaaaaagtattgtttacaagttggaaaggatgtaaaaataatctaaagtatactaagtcaggaataaaaggcagagttaataaaattgtggctggtactgatagacgaaacagatatattttctaaatcctggaataattattaaaaaattttacatgtatcaatggattccagactccatattttaagtttcacaactactgtcatttaaaactataccttattgaacgtctcccactctcaataaattaccccaaatcactcttctccaaaacgtaaatttggaacacactgacttacaaattttgggcttaatttataggatgttgtggccctcaaaaatatcattgtgggctaaacaaaataaattcttgaaacaattctaaaaatcaatcattgtccaaaatgaactttttctaa

SEQ ID NO: 159 - DNA, 671 bp, Homo sapien
cctaattttattacttttcttgccactgctattattgatagaaatacaattaaataattaagatgaaccaatccattggaagattactaaaattgtatcttcccaatgcctcctacagtaagatttctttataattataacccttggagacaatttgaactttatttaaatgttctgctcaaatctaaatttccttctcctaggctgaagcctgatctaaataaggaagtagttgggatatatccacaggctgtcgaacatggagctgcatctgagagacaggtggcagcaaccaaaagcaaagcagggactgagaacaggcaggttccaagagcaaaatggaacttgaaagccaagtatggttcactgtaaaggagaaaatatagaaatacggaactagaacacctggtctgggatgtggtaagcacccaaaatataggaaaactgtatgaattcttgtgaagcagtaaactatgatagtaatcatgtgacacatatgataacaaactcaaaacagggaaaagaggggctttattcaatgctggagataagtgaaaaaaaaagtgaagtgtctcaaggacagaagttatcatctcaaaaaggcatatcagctagatctcgcggaaaccatatgattatcataattctagactctgttcggtattacaaag

SEQ ID NO: 160 - DNA, 315 bp, Homo sapien
ccagagagggagggctctgcttcaccacagggcaccagaagaggactggtgcgcgggaagaccaggtaatcataatgctattaaaaatagcagtaatcatactgttttatacattgtataatgtcataaggattttaactttcatgtaacataattgctgtaaaagtttccccagtttgttttgtgctatttaccctggtgttaaaatgtgtaagaatttacattttaggtatgttaggtttattcctttttatatggtttctgtttgaaattttgattttagaagacattcattctcaaggtcataaaacacac

SEQ ID NO: 161 - DNA, 607 bp, Homo sapien
tttytgtgtcaccttggataattgcttaacttttaaaatttacgttccctcatttccaaaaagggattataactcactgttattttgataattgagataaatgtacgtacaagtgctttgaaactgtaaagtgcattataaacagagggatttaccatagaggttctaccttgatgtatcaagagaagccttttctggaatctggtgcagccttgtgagatgctgttaggtaaggggactccttggtagaatttcttacatttgtgtaaaaagttctggttcctgagtaattccaaagaagatgctatgaggagttcactgtgcctttgatttgatcccaatgggtcagaatatgttttctcattcagtaggctactacaggatttgaagtagaaaaaacagggtccagtgaccttcacgggatcctagatgttcatgaatttcaatcatttgagattgtggggtgtggtccaatgctgctctcaaaaagatgttgcctttcttcasagagcattaataactaaaaaatcccctggtcccaaatttattgtgtgtmtctgaaggctttaactgaagaaatgaaawgcacactcatggaacaaactaa

SEQ ID NO: 162 - DNA, 443 bp, Homo sapien
tgagttttgaaaaagtgaataatcaaaaggaaaataattccttgttgttcataaattaagcatcactaaagtctcttgaaaggcatttctgtattgggcaagatttaaaatactaaagccttaggtcctattcatatttaaagtagcatgtttgtaacctgttactatttggagagagaagcagttgcctgccacaattgaagactacctttcaaatagcaaaagagagagagaaggctgatatttcgggcttttaaataaagatttgtgtggttctgcttttactgtaactgtcactttcccagtgaaaatgatttcatatacatttgagggtcttacasgtatgggtaaagttctataaattgcaacaaaatgatacccaatttcattttatcctttttgtattgtgaaactggaaactttatgacattgtaaattatcag

SEQ ID NO: 163 - DNA, 686 bp, Homo sapien
caggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatcccagaacttggatttagcatatcaggtggtgtcgggggtagaggaaacccattcagacctgatgatgatgtaagttagctttgtatattcttgaaacacctataaagttttatttaccgattgaatacttaaatgtaagtgaaaatctaatagatgtttatgtaaatctaggtagacatcacctggattccccactctattgcttacctttttgttttgtaatttgatcagttcaagttaaaacaatttaaccaaaaactatgaatgtttatgatataatgaaatgattgttaactttcttattgctttttcacacacctataaaagtaattttattactcccaagagaaatcactaaaggcagaattactagaggtaaaaataactagggttggtacagtattactcaggagaagtcaaggggagaaaacttgtcccaatgattcaaaataattttggcatggggggggggagggaaaaaaatttggcttccttt

SEQ ID NO: 164 - DNA, 706 bp, Homo sapien
ttttttttgtttcatttgctgcttaaaataaaaattataaattagatttaaatggagcactaattataaaacagattgcaagtaccaccatttgaaaaaaaaaaaaaaaatcagtggatttccataacacagaaaatgcatggacatgcatctacagtagagttaaaaatttcctgtgactaaaaaattaaaaactggaatcaccagtagcaaatgtatagtcaatggctatgacaagaacagatcctgccgagctcataaatgcaattattggcttttttgctttataaaaaagacattacatattttattgcattattctcctaataaaaaacatactaccacgtagctctccccatccccattctttgcttccagatttttatagaaaataactgttttagtctggccttggaaagtgaacccaccagcaccaccttcacctactcactcttcaattcaatatgcacatagcaaaagccaacacttcaaatctcttgcccacatcaaaaaaagtagtttcaggagaaaaacattaataccagttgaataaaaataagggcataaaagctatgagagagatagctctgccatctgtctctgggctaaaaatcaaggctaactattgcctttggcaccacaaggttcaaggtccatggttttattagaaaagtccccacaaaaaaattaaacccccctcacccca

SEQ ID NO: 165 - DNA, 427 bp, Homo sapien
tyywgggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaamgtctcaggatacaaaatcaatgtacaaaaatcacaagcattcttatacaccaataacagacaaacagagagccaaaatcatgagtgaactcccattcacaactgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatggtgaaaatggaaaaa

SEQ ID NO: 166 - DNA, 124 bp, Homo sapien
accatgttttcgttgtgtgtgagcagggaagggaactttcctgccttatttaaacctgggccgaggattcgtggaatctgcttgatcagagactctgaggccaaaaacgcatcatacttcttgg

SEQ ID NO: 167 - DNA, 232 bp, Homo sapien
tctgcatagcaaatatgatttaagaatttaacatcattatttgatcacaagcgtaaatatgtcaccataaataaatgtaaattcattgtacaaaaattcccaacaactcttaatacaaatatggtacatttgacagtttctgaaacagattatttttaaaactttttaaaacctaagctttatttttttcctggttattagacacacacaaaaaaaataaaaagaggctggg

SEQ ID NO: 168 - DNA, 677 bp, Homo sapien
tttcacaattaaccaacatgcaaaaattctcagactaaacactgagaaattcttcatacaatgcatttgccaccttattgcatttttaaaatctttattctatagtgaattggtattcccaatctgcctaagcaaaggcatgcccttctaacaagatttgcttagagcagaggtgatagaaggaagaatccgaagaccctctggcatggcaatctgggagcagcacattgttgatggagtccaagtgagcacatttcacacaattcatttagtgacaagtgggcttgctcccttttcatccaggaaaaaaactactcacagaccactgcccagaatctggaataagaaccctcattttaaggtattcttcccaacaaataaatatctaaatattgaaagggggcatatcagaaaacttaaaagacacaataaccaaaaccaaaaccctcttcaaaacaagtaagcaatgtctgtatttagttcactctaaaacattcttagcttttcttgcagtttgttcctaaaagatttgattgggcacaagaggaacgaaattattaataaaataaaagcttatttttgtttttgctgtggataatcggtacaaaacgtttccagatctgagacttaaatggatcttttaaggtgaaaaggagaatgccaggttctactgaaat

SEQ ID NO: 169 - DNA, 635 bp, Homo sapien
ttaagaagactgggcatttatactctctcttgctagtcagcctggagcaagcttggagcagacgcacatttttgtactggcacatattcttagacgaccaattatagtttatggagtaaaatattacaagagtttccggggagaaactttaggatatactcggtttcaaggtgtttatctgcctttgttgtgggaacagagtttttgttggaaaagtccgattgctctgggttatacgaggggccacttctctgctttggttgccatggaaaatgatggctatggcaaccgaggtgctggtgctaatctcaataccgatgatgatgtcaccatcacatttttgcctctggttgacagtgaaaggaagctactccatgtgcacttcctttctgctcaggagctaggtaatgaggaacagcaagaaaaactgctcagggagtggctggactgctgtgtgacggaggggggagttctggttgccatgcagaaagagttctcggcgggcgaaatcaccccctggtcactcacatggtacaaaaatggctttgacccgctaccgacagatccggccgggtacatccctgtctgatggagaggaagatgaggatgatgaagatgaatgaaaaaaaaaaaaa

SEQ ID NO: 170 - DNA, 533 bp, Homo sapien
ctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtctgaagaccctgagttatctcaattgttcacggttacagatggaactctttattattgaggagttccactctttcccccatttgtcactactacacttccctagtctttaaaacaattttaggctgggtgcagtggctcattcctgtaatcccagcactttgaaaggccgaagcgagtggatcatttgaggtcaggagttcgagaccagcctgga

SEQ ID NO: 171 - DNA, 568 bp, Homo sapien
cccttgscaaactttcccttaagtattgcactacaagtctaagacacttttcactcaaagttccttccttccttacctctcttttaacttggagtcagactttcatcagtctgacaacttctccctgtctccttccttttccccccttcacaagcatttcacctaacaaatttcttatgtgcttaatcccctcttagaagcagatgccaagatgggattaagcacataagaggtcctggactaatacaatgacaaaggctccccttgaagcatcacactaaaaggaaaaaaaaaaaaaaaacctagccattttacattaactatttctaaaatatagtatttgcttccctatttgctaaaacaaaatatactaaacatgactattccaaaaatctgtagggtactaagaatatgaagagattcactctacttcaggggatggagttgtagtagaaaaggctttgtggagggagggtggtgtttgaaatgtactttaaaagccatcctcaaagcctcgagggctatacctggcctggtgattatccaaggacagtccattcaaacaggg

SEQ ID NO: 172 - DNA, 167 bp, Homo sapien
ccatttacaggaatcagccacttcagttcagacagctttattaaaccgcctggagcgaattttcgaagcatgttttccttccatacttgtccctgatgctgaagaggaagttacttccctgaggcacttgctggaaacaagcactttgccaataaaaacgagagagg

SEQ ID NO: 173 - DNA, 391 bp, Homo sapien
cctcccaaagtgctgggattacaggcatgamccmccmcgccctgatgatagacacgtttttaacttctaaaaatatatgatcatgattgtgtctgtggagacttgcacatatactaaattttaamcaattagagatatttgttcattaccacattttgggagtcattatttcctctatgaagagagaaaggaatttgatacaagttcacaggggcttccagtagattgagacttttatttctagctgagctgctgatgtatgaattttttttgktattatgactttcatatgtattaaaaataaaatgaaaaaacaagggattaggtgaggaacctatacgtctctaatatgcaaaataccacagaaataatgactgktgggaaaattagg

SEQ ID NO: 174 - DNA, 474 bp, Homo sapien
gaactcagagagaggattgtcacccttggcatctgagctgacactataaggacaatgaggagtctccttggggatagatggggagatggaaggacgatgcctgtcctacggggtcttggaaggttagggatacacactgtgagctgccacaggctcaacagtacggatagggggtgctggaaccagccagggctctgatcaccaagctatgtgccccatgcagaggaaggggtagtggcacactgaaccacccagccacaaggctatctccccatacagggcacctttaaaaaaattatccttacaggggaagacggggaggaaggatgaactgtgtgcggtgatgttgcagtgagtgtgagtttgtgtccgtccgcttgtatgagggcctaccttttactaactagcccccaactttcattatctcccctttttctgtctacccttctgcctttttaaagtggcttgcaatcc

SEQ ID NO: 175 - DNA, 655 bp, Homo sapien
ccttgcaggggtggggatgtgtgggcttgttcactgttacagcccatgtatacctgaagggcaacatgtacccacaaatgttccaggaggtaaataaaaaatacaattcagcctcttctaaaccatccttgttgatatctctgctacttccgaaagttaattcgttatttggactccataatttttcctattaattcaccctatgtccaactccaacagtgaaaaaaatttatttaatctttgcaataagcctataggcaggcagcattatcctcagtctgcagataagctaaggctcagagaagcttgtatactgtcacttaggtagtaattgcaagagctggcattcagacccagactgtgggactcctcactccattctctttccccccactaggctgctccttaaaatacaatggatgcttgatgaacgcttgtgggaatcctgggtggacacagttccttttcggccaaaagcaccttgacgacttgtgaagaattaatctggaaaacttaacctatttataaaaacgtgttattaagggcaggttattcccaccccctttaccaaagaaacccgccctgacctttttttactgggggttggtcttgggcattttcaacaaggggggaacagtttaaaaattcccccctt

SEQ ID NO: 176 - DNA, 660 bp, Homo sapien
cctggtcaaagtgggcattaccattcaagcattactagacatcaccgtaacgaaggctctgttcacatgaaactaccccttctccattgggggctcagactctgctctcatccaggatcctgaactctgctccaggcacctgttcaaccctctctcccacccactgcctgtcacttcactgactccagttacattgaaacaattttcagtctaagggaggattttctacctttcagagctgacctccgactttaagacttgacaggtatttatcttgaaaccagagagggagctggaggaaaaaaaaactgagcaagcacatcaatgccttttccacccttcttcatcctttccacactcaccgactgccattaccaaaacgccaagcacaaccggtttggaacaagacgcattccgttttaattaaaaccaactcattatgtattttagtgggggggaaggggggcacaatcagggttttcaccaccaaattttccacacggtttctgaacaccattgccttttaaaaaactatttttccacctccaaaatatttatttaaattttatttattacggaggtggtattcttcctttgggagccaaattgggaaatttagggaaccttttttattacccggttttttgggcgggtaaaccc

SEQ ID NO: 177 - DNA, 459 bp, Homo sapien
ctttttctcttcctctgtggaatggtgaaagagagatgccgtgktttgaagagtaagatgatgaaatgawtttttaattcaagaamcattcagaamcataggaattaaaacttagagaaatgatctaatttccctgttcacacaaactttactctttaatctgatgattggatattttattttagtgaaacatcatcttgttagctaactttaaaaaatggatgtagaatgattaaaggttggtatgatttttttttaatgtatcagyttgaacctagaatattgaattaaaatgctgkctcagtattttaaaagcaaaaaagggaatggaggaaaattgcatcttagaccatttttatatgcagtgtacaatttgctgggctagaaatgagataaagattatttatttttgktcatgycttgkacttttctattaaaatcattttacgaaaaaaaaaa

SEQ ID NO: 178 - DNA, 720 bp, Homo sapien
ctgcaagctcccactccttccatttatcttaacgcccaggctgacttctaagctgcttttcactttcctacctccactgcattttcgcccctgataatttttgtaagcttacctaagcctcccttcttttgagatccccttcttaaaagggtccattctattaaccctaccccatatccagttacttttactacctgctgatctatcgctaccttgtccaattcatgggaattacagggtgcactgggacaagagtaaaatgatccaacaaacataatgttgcatttaaaaaaataagctaaaagatactgatgactttttataactacaacatattcgtttgtgaataagaacatatatagtaaaaagatgaaaatgtgaacaggttgactatttcctaaatttatggcagaaggttgttctggagaggatgggaagaaaaaatgaaggctggcagtgatgggtggggaaatgcaacctccaaaattatctatctatatatttttattaaaaacacccacagtaattatggcaaatgttaatggtttgtttgttctaaggttttggatacatttaagatctcttgctttctgggtaccatttcttttcttttcttttctttttttttcaaattaattccaaaagacttatatctgctacatgaagaacgaagcaagttcagctctcttggctgaaatgttcaaatgcttgagggcaagg

SEQ ID NO: 179 - DNA, 427 bp, Homo sapien
ctgtgaatctgtctggttctgaacttattttttagttattggcaatctttgtattactatttcaatctcttcctggtttaatctaggagggttgtatatttccaggaatttatccatctcttgtaagttttctagtttatgcacataaacgtgttcatagtagccttgaataatcttttgtatttctgtgatatcagttgtaatatctcccatttcatttctaattgagcttatttgaaacttctctcttcttggttaatcttgctaatggtctatcagttttatttatcttttcaaagaaccagctttttgtttcatttatcttttgtattgtttttgtttgtctcaatttcatttagttctgctctgatcttcgttatttcttttcttctcctgggtttgggtttagattgttcttggtttctct

SEQ ID NO: 180 - DNA, 728 bp, Homo sapien
caaacacaaaagtcactgtgtgtgtgatgcttctccaattccactcatcctggctgccattcatgcactagtgcatgtatgcatttttacattttttaaattacaaaaatcaacctattataactgcttagatatatatgaagtaaaaatgaaagttctccctttacatgacccatcccccatcatttccctctttatcttatactgtcagcattcccagcttgtagcacagtgtctggcaatagtaaatcctcaaaaaatgatcaatgaataatttaataatgattaataaataaattaatgatgatggtgaagataaattttagcatttattgaacgctaactacaaaccagggagtgtggtaaatattttataaaaatcaatgaatgagctaaaatgccattctattatttttttggatacggtttaatattttactcataaatatgcttaaagaatattataattatatgacttagaatggtaaaacaatatgtacagcagtatcctattttttagaataaaaatataaatatgtgctcacatatgtggttggggcatgcctagaaacccgattagaacgggattttttcttaccaccattttttttacctgggaaaaatatgggaaaattttatttcccttctttttggttctaaaatttatatacaggagcctatttggctttggataaatcattttaaaaaaggtggtttaaaaaaaaaaa

SEQ ID NO: 181 - DNA, 546 bp, Homo sapien
acaatcctttggaagacactactgggctttgggtgctgctttttaataattgagttattttgagcttgccaagtaggatctattgcctggactaaaatttatttcctaatcttctgatgaccaagaaaggaaaaattaagtttgcagatgggagatgaaatatagccagcgaatatgcatactggttctgaatgaaaggaattaacttttcagtcaagaaacagtctgcatgccgtaaattgaatttttcctgcaactggaatgattggttaattctttttgaacactggcctttctccccaagaacactaatgaattgctaatattttttaaagaaaactggttttttaattaggtaagctccacttcctcttattttttaatccctaaagaaaactgttaaaagggaatggatctatcacgccttttcttttaaaaccacctttttaaaaaaggatttttccaacccccaatttgctcttattttaaaattttgaacgccaaaagaagggaaataaaaatttttcccttaattttaccccctta

SEQ ID NO: 182 - DNA, 333 bp, Homo sapien
ggccactctgactgggtctgctaattcacatgctctttgtgacatacggctctaagaggcagaggctggaagagaagtatgtgggttgtgggatcaagatacccaagtttcagtcttgacactgctattacttagtcaggtgaccactgtaacttcatcttgattgagcctcagatgtctcacctgcaaaatggagtttgaaatttgctatggttgggtgtcacacggattaaatgaaataatgcctgttaagcgcctatccagcacttaataagatggccactgcatcataatgctttgggcacaagtaacacaacatccaacccaaagggg

SEQ ID NO: 183 - DNA, 393 bp, Homo sapien
ctgaatttcttgggctttatgtggcagtgtggtaaaaatatatgatcagatttcactgttaagaaaattctttcagcaatacatgtagagtcaagtttcttgcatggataactgaacatgtgggttatgagattttaaaaaatgtctcgtgacaaactttacggaaatgcaacaatctggacatctagttttgtctgagagtggcgtggatatgaagaactgtgctgttggtgctgatgccacactaagttttggcagtcacactcttggttcttcatatttgaggagatgggatggtgaggaggcctgttggctttattttattacgtgccaccatctagaatacagattcttggatatttcatcttcacaaaggtgaagctgcaaactcag

SEQ ID NO: 184 - DNA, 700 bp, Homo sapien
  misc_feature (1)...(700): n = A,T,C or G
ccaggscawtgaggaaaagrgaaagaatwtarrggstwttcaaataggaaaaraggaagtccaaattggtcccntgttkgccagataaccatgattgkgkatttagaaamccccatgwtytcagcccaaaatctccttaagctgattaagcamcttcagtaaaktctcaggataaaaaatcaatgtgcaaaawtcacaagcrttcctatmcgamcaatamcagmcaaacagagccaawtcatgagtgractcttattcacaattgctagtaagagaagaaaatmcctaggaatacaacttmcaagggatgtgaaggwtctcttcaaagaagaactacaarccrctgctcaaggaaataagagaggmcmcaagtaaatgggaaaagcattctatgctcatggataggaagaatcaatcccgtgaaaatggkgatactgcccaaaataatttatagattcaatgctatccccatcaagctaccattgactttcttcmcggaattnggaaaaatctactttacacttyatagggraccaaaaaagaagcccwtgtagccaagacaatcctaggcaaaaaagaccaamcctggaggcatcacagtmcytgacttcmaactatwctaccaaggnytmcrgkgmccaaaacagcacggkacntggtmccaaaccrgacwtwtwgaccmmcagacacagaacmgagg

SEQ ID NO: 185 - DNA, 192 bp, Homo sapien
ccagyctttcttttaagtaagcgctttttcaagctcattgtagctacaaagtcaataaattggtctttgttatttttacctgaaaaggctgttaaaggttaaaatgacaaactcaaattcaaagggattggaggatttggtgtttatgatttctcagaacaacaatctagagaccaccagggtgggtttcag

SEQ ID NO: 186 - DNA, 688 bp, Homo sapien
gtgctggaattcgcccttagcgtggtcgcggccgaggtgggatatttcttctggatagatttcagataggtagttccctcaaataagattatatgggtttgcattttcaaggcagagttgtatacttcctgctctttatttaaataaaaaaacttgaaaatctgttctgcccagtattgtaagcgctcaggtacaaatatgaatgaaacaatctctgcctaagtaacacaagtatagggacaagattctcagtaaaattctcacgtgaaatttgtaactcactagacactatcaggagatcaataattatgtaattaaaaaaaataattacctgccaaactgggttcttctttggcacttctgcttggttttaagacaattctcacatagaagcttattattccccattagtcattccatagatgtaaaactggtagaaacaggacttgaattgaacattctttacaagtaagttatatagcttctgaaaaaagggcttgaaaaagcatttttggggactataagaaccttcaaatgctttcccctcttaacaaaccttaaaattattttgaaaataatttaagggggctgattttctcttgtcaaaatcttgaaccccacttaccaggtggttggtcaaaccaaagttcaaaaaaaagcttctggcctttcctttatcccacttgca

SEQ ID NO: 187 - DNA, 779 bp, Homo sapien
gcaaaaaacagatacattttcagtgtttaaaaatgaacaagtatggaaaggcttatacagtaactgaaaagtctcctttgggaagccaaggtgggaggattgcttgaggtcaggagttcaagaccagcccaagcaacatggcgagaccccatctctacaaaaaattaaaaaatcagccaggcatggcggacatacttgtagtagtaactacatgggaggctgaggcgggaggatcacttgagtccgagagtttgaggctgcagtgagccgcaacgcgccctgtactccagcctgggcaacagagcaagatgctgctctaaaagaaattttcttttaaagaaaaaagtctccctcatagcctgttctacaaaagtcctatttcttcccacaaaaagcctctggtacctggtgttagttcttggggtggaagattacttttaaaaatagaactattttttaagtatatcttttagggaactttagttcccgaagctttaggaaatgggatcttgaaaacaaaagggatttcaatacctatgacaatgcttaaagaattattggggcatttatttttcaatggagggtccacaaatctttggaaacccttggccaattaccagaagccactttaatttttgaccgaaaatgtttttaaaaattggcttttggaaaaactgtctctttccccaaaaatgaaaaccttgaaaaaaaggggaatttttaaggttgccccctcattaaattttaacccctctgaaagaaaaccctcttgtgacagg

SEQ ID NO: 188 - DNA, 394 bp, Homo sapien
  misc_feature (1)...(394): n = A,T,C or G
ggcgamgtctggycaccatcatgccctttaatcaactcacacctgtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggyaccagaagagggctaagatacgttytctgtcttngagctgaaagcacagyctactctccttcgttttgycgatgagaaaagttgaggccagaagggaggtgacatgtttagagtcacccag

SEQ ID NO: 189 - DNA, 681 bp, Homo sapien
aagttctgactttggtctataaaacagggttattggctgtggctgcactcaatatctaaaaagttattaggaagtgcctcgttattgtcattaaagatatctaaatatggtagaccaaaggttgttgagaaacacatattatggactgagttctgtttcttctgctgtggcgcacctaagctcaagccttccttctctccctccccttctggccggcatggtatctgagctcacagacagacaaggcatgttagaatcatcagatcatgagcaccgtgctgggatttagccctctccaaagtcaattcttacagtccatactttgcttaaatcctcagttgttgaggtctgctctgctgtcagtaatcccagctataaatttcccccaaatgtggggcctagataaagtagaaggtggatggactcagcttattttcatgggatgacaggaactggaaagagaaagggcattgaaaataaaaagttattccagaatagcattaaccctcttactgttcaagaattaagaaagcctacttagaaatgagggccttgagaatgatacccaaatattggtctttctaccaaaaaatggcctttccaaatatctgctttcctgttccccaattggctttttaagtagaattaagttacctaaaactttacctgaagggtggtttt

SEQ ID NO: 190 - DNA, 839 bp, Homo sapien
caaatacatgatttccattggcatagactcttctatagtctctcaggcacaccttatgactaataagaacactgtcttctagatataagccaagttttaggagttatctttgtagtttctgtgttgagactatgggtcttccctgtgcaaagacttgattagcaaatactatttgaaacgatcccaaattcatagtgcagttgaccacccttctgatcaaggggatctctgtatatcccatgaaagcttcataggtctcaccctagattaagtgcttcacttctcaagacagtgaacagatggaagacttttgtagttatcattatacaactgtgccctgtgtgttttattatacaaccagagaactgaggcactggctttacctgtcagctacgccaggggtgtgacgtcatctttctgacttgatcacacatgccacattgcttaatatttcaagcttagactgaaataatcctgtggtaaaaaatttttggggggctggggaggtaaagaacaagggggggaactttggaatatttttattcattaatcatatttcccgaattgtattttattttgaaatgaccataagggacttaaatacgtattgtggttaaattaaatggacccaaatggaggtaagtaaacctaatgggacaaatgaataaaaggtttatgactgggagcatttacccatgaacctccttagaagctatttaacctttcttttggaaagccctgaaggctgggaacttaaattttaaagacagtacctatttccagaatcgcttccaaatggccatgttttaaagggccaacattttgggatggccctgccc

SEQ ID NO: 191 - DNA, 697 bp, Homo sapien
ccatcctgaatactgattttctaatggaactctattcaatggcgattgtaaaaccctgaggctccgttactattatggagcatactttcatctcattctcggctattgggcaatatgtatctcataagattttatcacatttcacagatgaactgttaattgattccatgggtacgattaggcgagatccaagctggagctgcagctctgagtcccataaattctttgtgcttctgtaaagaataaatctgtttttaatgcaaattaaaactactggcagggaattttggctcccagttattaaaagactggaaatgtgtaagtggagaaaggcaataactgcagtaatctcttaccggactctattataattccaaacatacataatggtgagaaaaaccgggaagggaagaatgtggcaatgtccactctttgccccaaacataacccttaatttccatggcgggcccaaacactggtaaaaaccaaaatggtaccctctatagcatgcaacttttatttcactccaaacgaaaaattattttgactatggcttgggaaatccattagtagaagaagttttataacctataggaacccggccatttcatttctaccaaatcacaggaattttagaatgggcaaggaatttacaggaagacttgcccaattatctttttttgggggactaaaccaa

SEQ ID NO: 192 - DNA, 687 bp, Homo sapien
ctggttactatagctttgtagtataatttaaagtcaggtaatgtgattcttccagttttgttatttctgcttaggatagctttggctattctggatcgtttgtggttccatataaattttaggatagttttttgctatttctgtgaagagtgtcattggtactttgatagggattgcattgaatctgaagattgctttgggtagtatgaacattttaacaatattgattcttccgattaatgaacatggaatgtttttcctttatttggcgctctctttaatttccttcatcagtggtttataggtttcattatagagatctttccttcttttgggtaattcctacgtatttaatttatgtatcgctattgctaaatggaatgactttttaaatttctttttcacattgctcctggtggcatattaaaagctactgatggatggtgattttggattctgccactttactggaattggtggatcagttctaatcgttttcttatgcacccctttacggtttctacatgtaagaatatatcaccttcaaacacggataatttgacttcttccccatccaattgggaggccctttatatcttctcttggcctgaaggctctacttaaaacttcttatccctttgttggaataacagtggggacaaatggacatcccttgtcatggtccca

SEQ ID NO: 193 - DNA, 493 bp, Homo sapien
ctgctaaaatgatgttgctaaagcattcctttttcttttgattaaacttcatgtttacaaaaaaattaattctagcagaataacgaatggttttgttttctagttctctgctgaatgaacagttttgccaattatcttcatagagtagtgatataatgaatgcaacctcaaatgcaaaccaaccaattcacagtccataccccaatcacttccttcatcagcctcaaaaatcgctaagtgaaccagtagaatggttttggagcagtaataggaaagcaaatagaaagtcaagggggactttcaacgccaacaagaccaattcagatcctgatctgactggtttctaatacaatctctttccagagtaatggagcatgagtctgccacacagaactttagagagagtcctttatttcaaagactgtaaagttggaagaattcattcatctgcaaagtcaaatgtcaaaagttgtgcttcccactcctcatcagg

SEQ ID NO: 194 - DNA, 424 bp, Homo sapien
  misc_feature (1)...(424): n = A,T,C or G
cyagggcanttnagcangasaaggaaatanmggggattcaattagggaacwraggakarwcaagttgtccstgtmtgcagatgmsgtgattgtatatctagamcaccccattgtctcagcccaaaatctccytaagttgataagcawcttcagcarmgtctcasgatscracmtcwatnsgcraaantcacmwgcattcttatacaccaatawcagacaaacagagagccaaatcatgagtgaactcccattcacaattgctacnmaagagaataaaatacctaggaatccaacatacaagggatgtgaaggacctcttcaaggagaactacmaaccactgctcaaggaaataaaagaggatmcaamcaaatggaagaacattccatgctcatgggtaggaagaatcaatatccgkgaaaatgg

SEQ ID NO: 195 - DNA, 229 bp, Homo sapien
  misc_feature (1)...(229): n = A,T,C or G
tgaacacccttnggaaggaacctgctcgnatgtannanaaanggaccggacagtctgctaaaatcgccctctttagacgcggcgcgccggggcagagtttttctctggtgctttgacctgtatttggtttaatggttttgtcctaatctcttcaatcaataaaattgtgcgtatttaactaaaaaaaaaaaaaaaaaaaaaaaaaaaaaaaaaaaaaaaaaaaaaaaaa

SEQ ID NO: 196 - DNA, 557 bp, Homo sapien
gcggtggctcatgcctgtaatcccaccactttgggaggctgaggtgggcagatcacttcaagttgagagtttgagaccagcctgggcaacataacaaagtgagatcttatctctacaaaaaaattaaacaaacaaaaaaacaaatcaacattcatttgcagggctctttggtcttcttaaagaacaaacatatgaaataaataagctgattcttaaagataacaaatataatgagctttctcaactgtaaaagcatctctaagttgttctatcaatgcatatccactccatgaactaacctgaagaaagtgttgaccattctacccaattaactgtaaactaagattgctttaatggtttgcctaaatttgagtacctttaaatttttgctttttatccaaattcattctcccttcttcaaattaaatagttttgttagaaatcggataagcaagatgtactttttagaaagggcaatagaatcctacaacatgctagaatttgaaatgtttttttaaatcagtmmtttctctatgctagtaactaagaaaattata

SEQ ID NO: 197 - DNA, 624 bp, Homo sapien
ttttactacctatatttaaaatgatccctgacgcccctcaagacaaatatattaatttttttactttgtgggatagagatcagaaaaagagtagagatgaaaatactggagaaacaatgcaggagatatttatgaggtgagaatgtcaagaaacttgtaaagggagaatactataatgacccctgaagagagagctttagaccagttgagtattagaggttgccacgtggctattcatccactaataaatacaagaaattactaaaatggaagccactggaaatatgttttgaggaaggtgagaatgtggacctattataaatgggtgaatatgatttctttctcattaagttcataaataactttcagacatgtaacagtttatgaagtgtgccgtagtcatttagtataagttttatacacaaaagtgtttttactaagactgtcacaggttcttttgtgaatcttgtttgtttttcctcattgtaaatactgcaatagaacatttgtgtcttaacataaggcaataaatgaccttaagaaccttcacttttatatagaaagtggaggaaaagttggcagagtaatttgttgattatagataaaagctcttgtagaaattgg

SEQ ID NO: 198 - DNA, 175 bp, Homo sapien
ttttttttttttttttttttctaacacttatgcatttattttcatgtgtaagaagaaaaacgtaactagcacgtgaacatgactgcatggatacacggctcagcacgaggctaaagtcagaagtgagtgaaagcaaaaccgcatgttgatttaagtgaaataacagaacagaaaa

SEQ ID NO: 199 - DNA, 871 bp, Homo sapien
ctgttgatcaatgatgagctcccaagagtaaccagcctctatatagtcagcatcactggtttctcaggaaaagcatcaccattgttcatcttgctgcaaaatgtatgcacaagtatctttttatttttaaaaaagccctgacattttatgactgctgcttttctaagatattttcaaatatacagtccatacggttcagacacaatggactggggatagagacggctatagtgccgataatggagaaactagccagagcttcagatatttgttttccaggacatctcaataattgggtacacctcacaatatgtgagacttgacgtcgagtggcacggcatactctggcgcaggcacttgataaagactgtgtttgcaaatacttagcctgcacttcaagataccaggcatctaagcacgtcccagatggtgacagttaatcttcaaaaaaccctatgtggaagtattatcattgtcctcattttacagatgaggaaaaagagacacagggatgtcaatatcttcctcaaggtcacacagcaagtaagtgatggaacagtggctcagccatgaagctattgctgttaaccactaggttgatttgccttcattaatttcttcctaaaactgcacatttcccgttagtccctctttttggtctgtcgtttgactcttggctactgcttagaggaagattcattctattattttctaacttagtaaatatgtgcaactccttggggacatgaccaggcaaaagctggatacagaaatgtatgcccaaacaccatcccaagttacccctaacaggtcttttctggaccctgtttgtaaggggggtatatttggaaaaatttttaaaattttctgg

SEQ ID NO: 200 - DNA, 737 bp, Homo sapien
gacattttgaaggtaacagcaatatctgtgtatagatggggttgtggttttgttatttatctgctattgctgaactatcctttgtcttgagcgataaaagagaagtaaaatactaaagaactgaactgtccatttctggaccatgagtaaagatgctggctgtcaaacttcctgttcatacattagtttatttatagagtgtactctctatgtaaggtattgactgataatgttactttgacttcagatagcttgcagtttaatggaggaagaagacaaacatgcaaataactaggtcaatgaggcatcctttgtgttccattggaagctaggctgctttgtaaccttgttaatttctgtggttttggagtgcattcattagcaaatacaccccttgttcttatccattctctgcttttttctttatttggcatttgatgacattttttcatgtggggaaattgagtcaggtgaggtggaaagaaaataaggacacgacactaaattctttgatgtttttccttaaaaaattgtttttcaagtgctccataaagggttgtgaagttttaagagccataggacttggattattgtgaaagagtgtctctagggggccaggttaaaccatttcaaggactctccttctctcatctcccttgttccacccagggtggcgacccccaaaaagcacaaagcctccctttcttcatgggaagggtaaggaacggaagggaacc

SEQ ID NO: 201 - DNA, 493 bp, Homo sapien
tctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataacacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacatgaacattattttgctttaaaaactataaacattgtaggagaattatagccagtcttcagttataaccactccaccctcctcactttctctctctctctctcttttttttttgctatgggatttaatgggaaaaatatgtaaaaactgtcactaa

SEQ ID NO: 202 - DNA, 283 bp, Homo sapien
cctttttatctcagtgacaccgtccggggacgcaggtggtggtgactcaaggctagcctcaaagggcagccccacctcctcatcctggaccacagagaccacctgcttggcgcgccgtcgcttttccgagagggtggctgactccggggtgctggggctggggctgccgcccccgccgctgttgctgtactcctcgccccagtcgatgggggctgccctcggacagcaggtgcaggttgggggcactgttacgcaagaccatgctgcccggagaggtagatct

SEQ ID NO: 203 - DNA, 713 bp, Homo sapien
ctgcttttgcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaacccgcaggagcggcaccgcaggtggatccagatcttcggacgccgtgtaccacatggtgtacgagcaggccaaaggcgcgccttcgaaggagggggctgtccaa

SEQ ID NO: 204 - DNA, 275 bp, Homo sapien
gtagacaagtacagcagatccagacaccagatctagctaggctaaatgtacagtatctaacttgatctgaactgaacctgtattccttgatgatgcctaaaactacatccatagaattctggtgaacctgtaatacagttctgaaagtacagttttatataataagatgctgatctctttattctttcaagtaagagtgctagagaacaaattgtgttacttgccttgggatttattgaacgtctggaaaatgctgtcttcctagatccaaacag

SEQ ID NO: 205 - DNA, 694 bp, Homo sapien
ctgttcctgtacatttaactgaaaaaaaagtaacttaaaataatataaaaatagcactcatgtatgtcctacagttataggtgaaatttgatattgtttgtcttacatagcatacctatagacagcttaagtaaagtgactgttaagagggttatgcttattgatgaactcttgtagttgcttaccagctctgttagtatagttaaattgatctcagtagcttcaagtatttataaaatggttgaagtccaaatacatgtgataattacaatacactttgaattaatggagggtgggaggctagttgaaatgcattttatttacccaaggagtatgttaaaatgatagttataaatgttggaagtttaaagcaagatactcagtttagttctttacaaatcataagaagaacaaaattagatgttgacattgctattttaggctgtgtgttttccatatgcttcttgctttccctgtcacaggtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtaccgtacacaggtgctgggtcgatggccactttctgcttttctttc

SEQ ID NO: 206 - DNA, 704 bp, Homo sapien
  misc_feature (1)...(704): n = A,T,C or G
tttttttttggnaaaaacagggtttcatcatgtttgccaggctagtctcaaactgctgacctcaggggatttgcccgcctcacccaattcaactttcgtaagtcagtatttaccatctaactcagtgtcccaaaatttaaaatttccttgcactttacagcaaaaatacatattggggctctactgaagcaatatatacatgtcaaaactaaaaatcagaaaagcaaaagggtccattcaacatatagcagcttatatttaaatatgtacaggtatgtatgttttcacagttagatctttaaaaaaatttatatttgatatgttcaaaaatacttctattggctataaataatattttaaaagctcaactgatcaaaatgcattccaagaacatatcaaattaaataaatcttctacgtctttaaaaacagataattgaagtcagtaaagcttgaggtttgtgttaagtgtattctgtcagtccctactactagggaaggcagaatcttctaaatacgatacgaaagaaactcccaaagcttggaaggaatcggcagctcctgaactttttggggggggcatccctcttcgggattgacatgcgacataaatgttgcaagctaagggaccccccccgggggagtgggccccaaaaaaaaccacaccttccccgtcaatggtggtccccccaccaaccttaaaaa

SEQ ID NO: 207 - DNA, 225 bp, Homo sapien
ccattttaactgtactgccaatagaattctggaattgtggaaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggca

SEQ ID NO: 208 - DNA, 678 bp, Homo sapien
  misc_feature (1)...(678): n = A,T,C or G
cctatatctatcaaaaaaaatccagttcctaactaataatctcccaaaaagaaagcaccaggaccagatgatataaatggcaaattttttcaatcatttaaggacaaaataataccaattctgtatcatttcttccagaacacttcctaactcatcgtatgaggccagcatcactctaatagcaaaaccagataaagccattacaagagagagtgacagaccaatgtggttttattgaggatgcaaacaaaatttaacataatatttaatagtgaaaaactggatgctctttccctaagttagagattaaggaaagaatgtccccttcactactcccatacaacaccttactgaaaattctagctagctttataaaataaanaaaaaccanaaaataaaataaaaggtgtacagactggaagatacagtgaaggaggaagaaataaaattttctttgcgcataacatgattcttctatgtggaaatcacagagatttgaacattttttttttttgagacagtttttgctcttgttgcccaggttggagtgtaatggcgcgatctcggctcactgcaaccttcacctcccgaattcaaggtgattctcctgccctcagccttcccggagtaagcttggggattaacagggcatggcaccccccatgcccccagctaaat

SEQ ID NO: 209 - DNA, 720 bp, Homo sapien
  misc_feature (1)...(720): n = A,T,C or G
attattttgaaccctagcatttagaaatgaaaaactttttataacaatcaaatacatgataaagtatgcaaagagtaggaaattattctgatgacatatggagggttacaaaggagaaaactttttgctacctctgataaagaatagactaaattctccaagaccaatctgactggtgtcataataaaaggaggtacacacggaagcacaagggatgtgtgcctctggaggaaaggtcaggtgaggactcagtgagaagacaagccaaggagccaggtcttggaagaagtcaaccctgttgacaccttgatcttggactaaccctgtggacaccttgatcttggacttttagcttccagaactgcnagaaaataaatttttcttgtttaagccacccanagtgtantgttttgttatggcagccctaacaaattaaaattatattttaacagagaatataaaattctaatataacattttacagtaaagcattcatggtcttttttttcttattaataaatccatcaaaacagaaagttttgcaaaattttaacacatttctctaccactactgtttctactctcttaaaactactccgcaaatataaaaatagaaggccaaaatgcatcattaaaacgatgtttggggactaatggccttaaaattctattacacttggaaatatacaaatattcaaagattatctattgatcacctca

SEQ ID NO: 210 - DNA, 277 bp, Homo sapien
tccatgtatttttatacagaatggaacaatatgtatgtatgcaatykttacattccaccatgaaataaaacagtataatgaaaataacaatagattcaaacaatgatatgctatttttttttacctatgacattggcaaggtcttcttaaaaaatctgcgaataaccgatgttggagagatcatggggaaatagccactcaaatgttactcatgagagtgtacatatgtgtaacttcacttggagggcaatttggtgatacatttaaaaagttttgg

SEQ ID NO: 211 - DNA, 715 bp, Homo sapien
gtggtagaaatactaattttgcaattacagaaaaaaacaaatgccattcacatggttyctaacaaaaagtgtctgaccacccccaccccccacccctcaaaaagcccttaaataaagaggaagatcaaaagaaaacaaaataattcccgagtttcacctcatacatacaatatagcacaggaagtggcaaagtttaaaataatgcctttactgttaggactagtatgctgtcaaaagccacaatccttttgttttagtgagttgattttcaatagaaaaatacaaatgaacatgtgtttaagttccaacatggattgagcacctctgaatttagtatcaaatgattaattttatttttcagatgtcaaatcttagtataaaattttccattattttaaacttcacttgaatctttaaaaaagctgtctaaattgtactatatgagttcagtttaatcttctgtaaaatgctaacaaattgaactgtcagcagtcttttaaaaaaaaatgggggctgggttatttctagaagaactctcattaagctttgaaaatcagaaatcagagacaaataacttcagatatagactagctccacaagcaaatttatacaattatctgtaacagtctatacatatatgtgtatatatatataccgtaaccactttcataggtaaaaaatattaacttcatgtcacactatgatcagaagtata

SEQ ID NO: 212 - DNA, 717 bp, Homo sapien
agcctcccccaatgccttaaaaggtcacagtagatctcagctctgaacagaaactcaactgaaactcttcccacaacccagcagtagatatattaaaacctacaattttcagggatacaaccaatatttaattcttttgagggttttgtgtttaatacaaggacacaaacacacgtataaaatgacgatgtcaatactgattaaacagaacaacaaaataagaagctcaaattatcatcagctattgtgtatatctgaaataacaataatgcacttgattctgaaagaatgattagagttcctactctgaaaatctaattgtcttgatgtggcgaagtgagaagaaaggatgatttttctaatgaaaagcatgtatacgggtagccctttgcgagattctgtcaaaaccctgaattttgcattagctgttttaccacccaaacgtttttacccgaggatgtgcagcaatgggaactctcatacactgcttgtgggaatataaatcagtataaccactttggaaaaccatttaacattgtcaactacagctctacacacaagtgctataaccacccattccactccagggtatacaccctaaaaatatgaagtgcccatgtctacccaaaaggccgcctaaaaggaatgcttttgagaagggttaaccttgttaattagtggcaaaactgggaaaacaacccccaaatggtcccatcc

SEQ ID NO: 213 - DNA, 599 bp, Homo sapien
cctgttttggcgaggcaggagggaagcgggatgggagtggtggttaggccaagggtagttcaaagcgattcagcaggatgatgaccacaggagtgctggagccgggcctttcagcccccgtgtggatgatgaccggccatccaggacatgcgagggcttgggacagtggacagccagtgccacacaaggaaggaccgattaaatgacacagttaaaggaatttggcctagggagtgcaagccagaaaggtttggtctttttatatatgtaacattggaaaaaaggaacatctcctgttccctgtattaagttttgactttagctcagcaaatgcagtgtttgtggcagtaaatatactctgataacaatgttctttcccaggaatttagagttttatgatggttattgaaaatgtttacatgacaggctgtcaataatattttttgcctctaaaaataaaacatacataaagtgtacggattttaagtatgcaactcactgaacttttcataccgtaatacaccaccctagtaaccctcccccagttcaagatgtagactgtttccaataacccctcatcctgttccttaatagccccc

SEQ ID NO: 214 - DNA, 789 bp, Homo sapien
ccttatgacaaaccttgctatgccaaggatatgcttcactatcttcatctatcaaaacactatgcatcatagatatctaattttttcatctcttgcatgaagtctttcctgatttccctctgctgaaatttctctcttcaaatgatgtgtttccatagtactttgtcccttttcaaagatatatctcacatcgcatattttaccacagttagtttcatttcttaactctcacactagattacaaagtcaatatagacaaagaaatgttcaaccttatataacctcctctgcctatgctggtaaattgcacctactatgtgttcaataagagcttgtctttttcaatatacaaaactttgtaaagattaaagaccttgtagaaagtcaagaggaagatagcaatttcacttctaagaacttaccctaaggaaacattcatgaagagatacaaggggttatgtgcatggatgttcattatcatattattcttcattatgaagattatgatggtaataatgaaaatgattatcttgtattgggccttatttgaagtcaagcattgagaatgtactttatctgcattatctcactgagttctcgtagcagccctataaggtacagactgttatctaagcttaaaaaaataaagttaatgtccaaggtcaaacaactagtaaaagaagggggctaggaaatttggaaccccaaaaggggcaacctctcaagggctatgaatccttaccattattataaggaagcttggcccatggtggcccaaaaaaaaccggg

SEQ ID NO: 215 - DNA, 765 bp, Homo sapien
ggatgtctgagcaggagagagaccatgtgaaggatggactgaatggagacttgtatcaaagagtctgagtatcaaagacttgtattagagagggttgttgtagtaatctagtcagggtatgagaaatggtttgtattagagtgtcaggagtagtcgtggcaaaaatatatagatcaggatgagggatgggcctcatctcacaccctgactccagtcaatggcagtggctccctggagtacactactataggaaggattttgtaaagttttgtctggcctcagtggagggtgaggtaggggaggagttctatgaacagttagtggtgtctgccatggttgaaacaatggagaagggggacaccttttctgtgcagatgttgcttctggtagatataatccacaatgtaatgggagaagtactaagaatcagtaaattatggagggtgtaaaagactactgatatttaagcctgcggaccggacttagagaaatgatagttaaaggagaaatatccagcaaacaaagatatgacattgaagtttgggactgcgattagtaccagagatttggattggaggtgatttgtatagaatggataggtgattttactcttgcaatttggattgaggggtggggaaaaccagaaaggggctggggggtaaattagtagaaggtcaccttgaattcattgtggtccatatcaatgctgaaactgattggggaactttttactcttgagtccctttgtaagggaaccccagaaag

SEQ ID NO: 216 - DNA, 780 bp, Homo sapien
cctttttctgtggcaaatggaggcttttcactgcctgtagagacaatacagtaagcatagttaaggggtgggtcagaacatgttaagataacttactgtatatgtattcccttgtattttgttaaagctggaacatttgatatttttccatttatttatgaaaaaatatgaacctattttcatttgtacaaggtaattgttttttaaagcaagtcaccttagggtggctttaattgtataagtcaagcacatgtaataaattcaaaacctgcagttaacaggatattagacatcaatcctggtaaccaaatattaaagattctctttaaaaaagactgaacatgtttacaggtttgaattaggctaaaaggtcttgcagtggcttttcatggcccttcaaattggaatggaactactgtactttgccatttttctataaatcagtactttttttttaattttgatatacattgtgtgaaaaaagaaaatggctaataaactgtattaaatcttaaacaatgtataaagattgcacttagccagttcaaagtgtatacttattcataatgaattataacagttatatttctgtgttttcttgtaaatgtttcttttcccttaaatacagataattcatttgtattgcttattttattatgagctacaacaaaaggacttcaggaacaagtaatgtattagtatggttcaagattgttgataggaactgtctcaaaaggatggtggttattttaaatataaatagctaatgggggtggtaaa

SEQ ID NO: 217 - DNA, 810 bp, Homo sapien
cttttaggcagcccggcaccttcatccataggcagagagagaactgggtgttggagacttattcgagggtataggaagggccctgtgaagttgatttaacttttggatgtcagactgtgaaagctcctgagaaacttggggtaataggatcttcttttggggatgaaaatggggaaggcgtgaggacctagactacttctccctaggtcagaaaaagagaattaccccttgacaaatatgatacctgctaggtatttcccagggaaatttagggattggcgtctttccctagcatgtggaggaattggcagacagcttcctaagggcggggagcgggggcccaaggctgacactgcttgcatccacgtgaccttaagttatggcagatgactctgaaacggactgaggccaatgagaacagatggatggagcactcaggttagacttgttccttctcctatgctggaggagagggatggttctctagaatgttggaggtgagttgagagctcgcctcttgaatgttgaacagtgtactcttctgaaaactgcatattcactttatgtggtttcagaatactgggctcaatactaacataagaaagacacttcattgagaaattcttaagcttacagaaaacctatctctttgcacattccacataacccctagcaaaatgcaggttcttcatacttctgtcctttttccattggaagaattgcttaaggaaaaattaattcctatttattcccacaaaaggttgggcattgctttgattttaccccatgggggaatgtgcctttgaattt

SEQ ID NO: 218 - DNA, 817 bp, Homo sapien
ctgctcccttatggaggtctcttcattaataattattggatagatagagaaggtgagcctgtggcttccaagtaccggcttttgctgaaggtctacatgggaagaagagcatcatttgatattcagtagatctgccacacccaactggctccatctcctggaaaacagcactcactacaagcaactgtaatagcacccagcaatgaccacgctgctcctgctggctcttccgtacaccagtaaatgaactcaccaatgtattgcacacatacatttcacagtagtacaataaagccctgtatcaggagtggtaattcaatgacttgactctatagtgcactgcagctttatgtcataccaacattcaaatattcaaatatccttccaatccatttggacaaaaatacaccatggctgccaagacacatgtatttttctttcttccatggactcctaaactgctcccacaatcagcagtgttcttctctcagaaattatcttaagcttctctactcaatgggaggtacacacagagacctgagaatatgcagaggccagaatctctgtctgtgctagagatcaactgtactctgcccacctggggaacacatcctctgggtaaagtactcggaagtaaattacattccctggagacagatacgggctttcactgcagcctgttagaaaacacaatgtctgtaagttacctcataggtcaaagagttttggattatatttttcataatggggctatggcctttttaccctggttttaatacagaaccacctgcagaaaggacattgaaattaaaagcca

SEQ ID NO: 219 - DNA, 661 bp, Homo sapien
ggatgctgaggcaggaggattgagtcctggagtttcaggatacagtgagctatgatcatgccattgcactccagcctgggcaacagagcaagattctgtctctaagaaaaggaaaaagaaaatgaatagatagtggtattagatgttaatgacatcagttgtttttattctttattctttcttagaaacagattagttttctcgaattaaagaactaccatttttcttttttctacaactttcaagagctggtgaagaaatgatgtttagatttaatagatatagtagcagtcatatattaatagaatagaaactgagactctaggaaaaagatagacatgagataaggagtaggcatggtagacatttctagattatttatgaaaatgttgtagaattcatttttttttttggtctgacctttggcaatggtgctgaggaagggaaagccagcccatcaggcaaggctctgttttctgcattttatcccgtttgattcttctcgttaggattggagcaaataatttcaatatgttcttcgctgggtttatcatagtgacccttcatttaaagggacttttaacaattgacttaaagaacactgagatgtgatattttattgggatttgaaagttgccattgggttttaccttccttaatt

SEQ ID NO: 220 - DNA, 792 bp, Homo sapien
  misc_feature (1)...(792): n = A,T,C or G
cctctttttattcctacaaataattttcaagtacacacaattgggtaaacaaagaaacaaagccaccaagaatgaaaatcagtaggaataacgaacaagactcacagatgtcaaacaagtctgtgggtcttgcagacttcagatgttggaattattagtcgtggcaagngnncaaaacattagctattaccattatgtttaccaactagtgaagtgaactatgagaggatatattaaccacagaagttaatagaagaatagactcctgaaaatatctggatgctacaaactaaaatatagtatataatccttcatagagtgtcagtgacttcatatttataattacatttttgtatattagcagtgttctagttcttactgccttatctttaagctgannnnaaataaaattatattttgggattcaaaaacacatagctaatgattactatgtggcagtgttacattactttatcacatatcattaacataatctgcatgtgttcaaagagatcttcatacttctttgtagctcccacttctttgtcgtctttgtagctcccacaacatctagaacagcacaaccgtatatggagaaaactcagtctagtattcgttgaatgactaatggaaaatttagttnataaacagaactttcttcattgnacaaattatcttgcagaagaataatggccttagtttaaaattatcatatttacccatntcnccangttattttatctcttttggctaanaattttgaaaacggtaccttttaccctttggcatttt

SEQ ID NO: 221 - DNA, 759 bp, Homo sapien
  misc_feature (1)...(759): n = A,T,C or G
cttttctgctgctccgggaggtggagtggcctggcagagggcacatggctgccacctgctgcaaggaaaattctcagtgaagactcctcagtatgaaggagataagcctgcacaatcagtcactgatagatgcttagtggaaaaacttccaattcccatttacagctctcagagctaggattaaaaactcctggtcataaactcatgtgatgagaagttatagcacgccctcattttctacatanccacttgcatttatggttggcttttgaacttgctagaagggaaagaagtgcaaatgtgtcctccttagagctactctcctccccttggtgggtttccagtttgtgcattgtccagatggcccaggagctgacgatcaaagggaagaagtcatgtttgtcatgagaatgctttgctgcatcaggattcagtgaagctgttcaccgcctggagcccatgcagcctcaagaggcaggatggagctcagaaaccatcactgaggttagaaagtgagcaccaaagttgagggaagcccacaggagtgagccgaagtgctccctttggatttccaaagtgggtgctgctgcttcttccatcagccttgcttctgaccccaatgcgttcctggtgccttcttcttggcattttgctgtcgggggcccaaggaaaaaaattcctgcatggcagtggtgaaaaaagatggctgcctgctgaaacctgatttggcctgggtaagccttttggagccccggttaa

SEQ ID NO: 222 - DNA, 699 bp, Homo sapien
  misc_feature (1)...(699): n = A,T,C or G
ccttntnaagagttggcattaattcttcactaaatgtaggagtagaatttatcaggtaagccacactgacctctggncttnttnncgcccgatgatttttaattagttgaatccctttacttgttatatatgtattcatatattctgttccttcttggatttacttttatgattggtgcctattgaggtatttatttctagtttgtggtacttcatgtgtttaggttttctagacagtggacatagaagattcaagaagctaaatgtaggagaatgtntaatgtagganantgaggcnacnatatcatcaatgaatgacttgaagtttcctctgttgtaaagaatgatattaccataactgccatagntaatattgatggtgtaagtcaaataanaaggcaggaggaaagggacatccatcactgaaccacanatcagagnctcattgaagcctttgagaagaatccacaaaattttacaggataattcatttcctgcgatcaccacnagaagagaaactggttaaacagacaggtattccagagtccaaaaatttacatttggtttcngaaccaaagacctcagctcccaggccacagcaaaagggggcttatgaattccctggcacccagncccaagacccaanaacctcatcttgattggtttngggcttgggaaaccaaaaaaccaatgggtggc

SEQ ID NO: 223 - DNA, 598 bp, Homo sapien
aaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcaatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcg

SEQ ID NO: 224 - DNA, 501 bp, Homo sapien
  misc_feature (1)...(501): n = A,T,C or G
aaacctttatgatgacttccttatgaattactgaacgaacactggaatgggactcaggtatcctgaggacatctctcaactctggccttagttccccctctgtaaaattagggtgccaactaaatgatctacaaggtcccttccagcgccgccattctgtaattacatcatgtgtaactgtattaaacatacacaagtgactgccaggcatgggaatgtaacttccgagtaaatgctttggtttgttcagaatacactatgaacttctttccaaagacgggttgtggtaaatagtggatattttgattataagaaatagagtttccttgaagctttagctggagatacagcaatagtgtggtgttcctacaaatatcacagtgtattcaaacatatttttctatcaaaaatcatttttgtaaaagctgtgtgtttttatccaacttgtgataataaatgttctttattttagaacaaanaaaaaaaaaaaaaaaaaaaaaa

SEQ ID NO: 225 - DNA, 295 bp, Homo sapien
cctgtatagggctcgtttccccacacatgcctatttctgaagaggcttctgtcttatttgaaggccagcccacacccagctactttaacaccaggtttatggaaaatgtcaggaaaaaaaaaaaaaaaaacacatgcactcacacaatacccaaacatcaraattagaagggcataaaacagggggctttataggctgaaaaatatcttaratttcaraacagaataccaatcaaatattgaaaattcctttgttcaaaacacaaagatgttttgtttttaatgggagttttttt

SEQ ID NO: 226 - DNA, 372 bp, Homo sapien
agattcctggcttagagcatgcgagcattgaaggaccaatagcaaacttatcagtacttggaacagaagaacttcggcaacgagaacactatctcaagcagaagagagataagttgatgtccatgagaaaggatatgaggactaaacagatacaaaatatggagcagaaaggaaaacccactggggaggtagaggaaatgacagagaaaccagaaatgacagcagaggagaagcaaacattactaaagaggagattgcttgcagagaaactcaaagaagaagttattaataagtaataattaagaacaatttaacaaaatggaagttcaaattgtcttaaaaataaattatttagtccgtatgaaatgaaat

SEQ ID NO: 227 - DNA, 599 bp, Homo sapien
ggcccccgtcgcgggagccgcttcgggccttctgggcatgtctgccatatggctccaggtttgtttttctccccggcactctgacggggagggctcccggcatctcctggcatccgggtagaggacgcggaggatgctgagctgctggcgcactgcagcacaactagagatgtacggatgcccccatcttgatcttacagaatcagaggtacagccgcgagaaagagtcaagaacagacagagtcgcttgaggactcaggagggtgtttgctgcgttgacaacagactacaccctcacagtttgctctgctcttccaacaccagtggaagatgatcacatcccagggatcagtgtcgtttagggatgtgactgtgggcttcactcaagaggagtggcagcatctggaccctgctcagaggaccctgtacagggatgtgatgctggagaactacagccaccttgtctcagtagggtattgcattcctaaaccagaagtgattctcaagttggagaaaggcgaggagccatggatattagaggaaaaatttccaagccagagtcatctggaattaattaataccagtagaaactattcaat

SEQ ID NO: 228 - DNA, 343 bp, Homo sapien
aaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaaccgctcaagtacacaattgtatgttctttgtatcccttaccacaaatatctcgctctgctcatttcttttgcagcttcctataaagtttgtcttcctcaaaaaaaaaaaaaaaaa

SEQ ID NO: 229 - DNA, 417 bp, Homo sapien
ctcaagctgcagtccaccgggtatggttctggatggttcccccaagggagcaggtatgtaggaggtgaagaaaactgagatttcaagtatgggagagtttttactatctccattcctggattaaaagtgctgaaaaagtccacagttaaacattcctttattcaccctatggctcccaagaaaagcattcttcctctggagtactggtgtactaaggggacaatacaccaaatttgttgagtttacaatcaagtctactaaggttggacttccttatcagtttggcagagtcccagggcagaataatcatccatctacaggtctctgtttcctctccctccgcagcagtggagagcatcccagtgtttggggcactgtgttcctcttcgtccctgcaccagaccctggaagccttgg

SEQ ID NO: 230 - DNA, 462 bp, Homo sapien
gaaataccagaagagaaagtttcattgtgcaaatctaacttcatggcctcgctggctgtattccttatatgatgctgagaccttaatggacagaatcaagaaacagctacgtgaatgggacgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacag

SEQ ID NO: 231 - DNA, 328 bp, Homo sapien
ctgtgggttttcctaaacgcccctcatctggttgaagccctagtgtttctttctcacatcagaggcaaatgcattggggtgggtctggtttggacaataaatttcctctggtttggaccaagaaaaacagagttctttgaccgctaacatatatgtaaaaagaaagtttgtaaaaacaagagttaaaatgcttctaacagtgtggtcatcactgcacaggacactggaattggcattcggggttgtgtctgtccatgtggtttcgttgtatgtcatgtgctctcagctcagacagagacatccaattgacttctgacttggggcattt

SEQ ID NO: 232 - DNA, 595 bp, Homo sapien
cgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttcc

SEQ ID NO: 233 - DNA, 600 bp, Homo sapien
atgaaggtaaactctaaaatcttcataggtcaacaaagaaaatttatccttcacacttatttctagaaagcagcagggcttatttcctagattgcttacaatgaagctagaatatctgcgataactgtagagtttcaaaaaggatccctagggctacttctacgttctccttaccagttgagcactctccataatttccagacgggtcatgggggagaatgatagaaatgagcgtgggaagaaagacaatgaaattagaaatgggtgagacacatggtggtagaatgctaagagcagggatcaggacaatcaaccaggtgtctaggaagggtcaagtcaccagtgtcatctgctgaccaatgttaggaagaaataaactcaaaggaaacaccacatttttccaattaaactcaaatctattgacttgtggtggttctttgatgttgtggggactgctataacagaaaccaattggattttcaagggcaagaaactttgccactgaataagatgatgtcatccttcctgataacaaataggaatgggtggtcagctctaaacagcgtggactgagggagttgcttttctacaatattactt

SEQ ID NO: 234 - DNA, 500 bp, Homo sapien
aaattcctaattcttttactatcttctcaacttttcccaaagataaaataaatttcacataatttcatggaggggaaatggtagttgtaaaaaactacctcaagtagcaatcaccgctggcagtgttttctcactttctgttctgcaattgcaatcacacttccaaaaagaaaagcaaatgtttgctaaaccatagacagacaacctctttgtgactggtattataaggtttataatgaaaacttatcaaatataaaaggtgctccctcttgaaaatgtgtattttatttgaagttttgagtaagaggtgagtgtttggcaattttcaacactcccctcaaaaatctcccaaagttgcaaaaaagtcagtttagtaaaattccaagcacttaaatgcttcattgagggccagttgatatacgcaatgcactaatgtgtaaaaattaaccgaatgcaactattttataatggagagctcttaccttttccttccagttttt

SEQ ID NO: 235 - DNA, 159 bp, Homo sapien
aaaatttacagataaaggcagttcaatactgccactgagaagtacatctcttaacatatacaactttcaggccacagttttgaaggtctgaagtattaagttggtttgatgaattagtcggttggcacttacgaacacatttattgccttgccatcttt

SEQ ID NO: 236 - DNA, 254 bp, Homo sapien
aaataagtgaataagcgatatttattatctgcaaggtttttttgtgtgtgtttttgtttttattttcaatatgcaagttaggcttaatttttttatctaatgatcatcatgaaatgaataagagggcttaagaatttgkccatttgcattcggaaaagaatgaccagcaaaaggtttactaatacctctccctttggggatttaatgtctggtgctgccgcctgagtytcaagaattaaagctgcaagaggact

SEQ ID NO: 237 - DNA, 591 bp, Homo sapien
  misc_feature (1)...(591): n = A,T,C or G
tttttttttttttttttttttttttttctaatttttactttttctcaagtttaatgtaracatacaaraaaacatcaagcaatgtttattgkgcaattccaatcattatttgcaraatcttggtttaaagtcagtytttatagccatttcaactgcttggtttaaacaaaaagcaacaatctggttatytacctataaatttcatggtatttytttaaacactgaagtactaaaagcactgatgatttgtattataatttttaaaatatttaaaacctacacagatttcataratcattccttttataaaataatcaaaataatttgattatytggaaaaaaaaattcttgaaacaragccctttccaggtatyttcaatctctgtaaaaccccaaaccccaaacagagtaratgatgaaataaggatttctcagttgcccaagactgtctgaaatttaaggttgaaaaatggactggcgtttttcatgtttcctgngaattcanagcttacaggtggcatcaaaactcaaatctctgggatggctttacatggctttcactttgatttgtttcattttcatttgcttctt

SEQ ID NO: 238 - DNA, 252 bp, Homo sapien
aaatggcttttgccacatacatagatcttcatgatgtgtgagtgtaattccatgtggatatcagttaccaaacattacaaaaaattttatggcccaaaatgaccaacgaaattgttacaatagaatttatccaattttgatctttttatattcttctaccacacctggaaacagaccaatagacattttggggttttataataggaatttgtataaagcattactctttttcaataaattgttttttaattt

SEQ ID NO: 239 - DNA, 153 bp, Homo sapien
ccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcag

SEQ ID NO: 240 - DNA, 382 bp, Homo sapien
aaaaaaaccatctaaaagtggttttttaatatatatattttttccaaaggaagaaatttcttgcttttactcagggaaaaaaaaaaattaaggtacatttgagtagaatgatttcatctaaaagagttctttcaggagacatctgtgattcactgcattgtttttattttcttctttttcctcttcttttccaacatttctaccattttcctcttcttggttgatatcaggccactttcttttgttgctttcttactgtcacctgttaaaccgcgtttctttgtgttaggttttgaccgcttttcttctttgtgcactgtgtcaccaggctcctttttgccaattttggactgttctttacttacaggagaaggctctgcag

SEQ ID NO: 241 - DNA, 400 bp, Homo sapien
ggcatgagccaccgcgcccggccctatcttttacttttataaatagagatgaagtttcaccatgttgcccaggctggtatcgagctcctgggctcaagcgatcccccaaccttggccttccaaagtgctgggattacaagcgcgagccaccgaaattattcttaactagcaagactaggctctgacatcacatccttatagttacatccctttaagcagggttcagccactcactctgcacctggagaacttgatggttatccctcgaagtgacagtcctgcaaatgacaaaaacactccaaatctattaggttggtgcaaaagtaattacgctttttgccactgaaagtaagtcccacaggaccctgagggaaatgggagggtggggtatacatagcag

SEQ ID NO: 242 - DNA, 75 bp, Homo sapien
actcacatatgcagacctgacactcaagagtggctagctacacagagtccatctaatttttgcaacttcctgtgg

SEQ ID NO: 243 - DNA, 192 bp, Homo sapien
gctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttgg

SEQ ID NO: 244 - DNA, 616 bp, Homo sapien
aattttatagcaatatactgaccattctaaaaataacaaaatacatgttgctctcaactacatagttaaaaaaggtagtaaattctcttacccaaaatagaggaggggtgggctagtgagctgctcaaacatttgtaacaaataaaaatgtatctatatacatataatgatcatgttttcatagcctaaaatcaccatacaaaatctaataataaaattgtgtcgtgttcaggagttgggaagccaacacattaaattaacaaagtatttttggtatatgtaaataatgggatagaatctctcgaatcaggattgtcccagaagttctaaggcagatgtcaatgacatgcacattgtccatgttcagtaattttcaaagactagaataaactatgtaaactattcaatacaattcaatattacttaactgctaaaaagtacttcaagatcttgcactgccttgagtgagtataatcaaattagtaattggaaaatagctgtaatagcaggcactgaagaattctgacaaataccaaataactgtttgtttttaccaaataaactggtaagatgatatcacaaagggttttaagttattttgctatacaaggttttt

SEQ ID NO: 245 - DNA, 165 bp, Homo sapien
ttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaagg

SEQ ID NO: 246 - DNA, 229 bp, Homo sapien
tgtactggatccctccaggtgggggcgactctcacctgactattacaatagcctcctaagtggtttccctacttgcaaccttgcccgtataatatctatcctccacacagcaggcagggcgatcctttaagaatagaagttagatcatgaaaatgctctgctctgatccctgcaaaagctcgccacctccttacagtcaccgctgaactcgtagcagaggttcaggagg

SEQ ID NO: 247 - DNA, 338 bp, Homo sapien
  misc_feature (1)...(338): n = A,T,C or G
ggaaaccgtgtgtacttatcctggatgatgccaccagtgccctggatgcaaacagccagttacaggnggagcagctcctgtacgaaagccctgagcggtactcccgctcagtgcttctcatcacccagcacctcagcctggtggagcaggctgaccacatcctctttctggaaggaggcgctatccgggaggggggaacccaccancagctcatggagaaaaaggggtgctactgggccatggngcaggctcctgcagatgctccagaatgaaagccttctcagacctgcgcactccatctccctcccttttcttctctctgtggtggagaaccacag

SEQ ID NO: 248 - DNA, 177 bp, Homo sapien
tgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaa

SEQ ID NO: 249 - DNA, 263 bp, Homo sapien
aaagtaatgactttattaataaatatacatccatatgatgatgtagatacaaatcatgaacactactccattcccatacacataattgcacacgagtagctcaagttcatggacataaaaacatacacagtatctattcagactttttacagcagaggacagcgtgcttattatcagttaattggtaattattttctccaaaattacctgtggaaaaaagaaattctgaaaacttaaaagaatcaaagtgatctgattacttt

SEQ ID NO: 250 - DNA, 333 bp, Homo sapien
aaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgcctcagaccatcttgtgagattgtttgcctatctcataatacagttttatgcagaaaggttgaaactatgtaaatggtttttatggaaattatcagttacaatatttt

SEQ ID NO: 251 - DNA, 384 bp, Homo sapien
aaaccatttgtacaaaacttctataaatttttctctctctttctctcttatgtacaaaaatatcttaatatatccccgaactggttaggatagatacaaatagattttttataataaaaaattcacaaaagattggaagcattctataatgaaaatggtagaaaagacagtgtgagggaagccatggggtttgggaatcgggccctggaggagaagcagagtttcaaagggctgagaatagcatagtttcactgtaaaccaatgtctacagcttattggggtgggggctactgagacgaaagacaccaactcgtttctagagggctaagaactgcactttaagaaagggcggggaggtgaagggacccgagcaagaactttcag

SEQ ID NO: 252 - DNA, 211 bp, Homo sapien
aaagcagtctgaaaatgggacatctgtagagaaattcatttccttcttctcctccggatgtggaatggaagctttgagggaaggaaaagtaggaaaagagcgggatgggatgggatgggatgggatgggatgggataggaagagaggctggggaatgggcagagaagggggtgctgagtgtgctgtgagatagagcaagatcacaagaagg

SEQ ID NO: 253 - DNA, 135 bp, Homo sapien
aaaaattgtttcttgacaagctgacttggcacttaagtgcacttttttatgaagaaaaagtacaatgaactgcttttcctcaagcaataattgtttccaacttgtctgggaattgtgtgtctggtaactggaagg

SEQ ID NO: 254 - DNA, 361 bp, Homo sapien
cctgtagcccctgctacacgggaggctgaagtgggaggatcacttgaaccaatgagggtgaggttacagtgagcccagatcatgccactactctacaggctgggtgataagagtgagaccctgtatcaaaaaaaagacaaggaaaaaaaaaactgggccgtttgtttttgcagaatgtctctcaatttggactttttgggcaggaatacaatacaagtgatacaaatgcttctttaacattagaacctgtataaaattaccattacagaccttgctattttacttataggtaaatcactgtttaccaaggtaagtcttttgggaatttccaaaaatgaagtccatggacagttaaaaactg

SEQ ID NO: 255 - DNA, 331 bp, Homo sapien
aaaaaaataaataatccaccaacgtgattgaccttggcgagatcatgtttctagtctatacctcagtttccccatctgtaaagtgaggataatgtcccaccccatgtaactgtggtgaggaccaactgcaacactgtgcctgcgagtctccttggaaaagtgtaaggttctacacaaatggaaagtgatctgatcacactcagtgtccccagcccagcctttcagtgccctggccctggggtgggggacaatactctcctcacccccttcactagtcttcatgaatagcaaggaggccataacataatttggtctaaaccccttccttttt

SEQ ID NO: 256 - DNA, 186 bp, Homo sapien
  misc_feature (1)...(186): n = A,T,C or G
cctttgggcccttgcactttgacctgcaatggggccacaccagccttgcttgtgtccacctggaaggactgagggaggttggcacgaaccatgcctgggctcaggccgggcccanagcacttgaccttggacgcatctgtcacatcatgcacagggaccttgaaaggactgcctggcacttgatgg

SEQ ID NO: 257 - DNA, 255 bp, Homo sapien
ctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccagagactcctccgactccacacctctcgcggcag

SEQ ID NO: 258 - DNA, 604 bp, Homo sapien
ctgaatttgcaatggagtttggtggtgcaatcggtattgattagtttggcatagacagatgcagcagtttagagcaaaatcgagaaaatgattttttttttcctccttgatttcctggcagaagatatcttactttttcagcaaacttttcttttaacactaaagcagcctagggcaatgccagatacttagagcttttctcttgattataagtagaaatgggggtgtctgggctagaggtggagggtggatgtgctgtcgtcacagtctagctggcagcaagcaaggcaaaagcagagactgctctagaagcggttccaagcagcagagacgtcaggaaaggcacttcttagtaccaacctctatgctttaatagttgcttgttaagctgcttcatgggttgagacaaactaccagcacttcaaagagctcagttctctgctcaactctcttctctagttacattattttttttccttcaggagactgaggcaggaaaatcgcttgaactcaggaggtcgaggccgcagtgagccaagatcacaccaccgcactccagcctgggccttgcaaagtgctaggattacaggaatgagccaccagg

SEQ ID NO: 259 - DNA, 429 bp, Homo sapien
aaaaatgtctgtatcgagatcttccagtttgaagtcttcctcctctgtgtcttcccaaggctctgtggcaagctccactggttctcccgcttccatcagaaccactgacttccacaatcctggctatcccaagtacctgggcaccccccacctggaactgtacttgagtgactcacttagaaacttgaacaaagagcggcaattccacttcgctggtatcaggtcccggctcaaccacatgctggctatgctgtcaaggagaacactctttactgaaaaccaccttggccttcattctggcaatttcagcagagttaatttgcttgctgttagagatgtagcactttatccttcctatcagtaactgctccgtgttcagactcctggtttcttccaggcttacagtggacatcatcagcttcctgcttt

SEQ ID NO: 260 - DNA, 385 bp, Homo sapien
  misc_feature (1)...(385): n = A,T,C or G
ctgcaacacatgcagcaccagtctcagccttctcctcggcagcactcccctgtcgcctctcagataacatcccccatccctgccatcgggagcccccagccagcctctcagcagcaccagtcgcaaatacagtctcagacacagactcaagtattatcgcaggtcagtattttctgaanacgcatatggcagacggatttgcgtataccaaggagagtggcataggagggaaaagcatatgtggctgaaacctgtaagttggtgttggttatgcagaaatgtgtaacagatcaaacggtcctctcaagtgtctattanataggcaataagaactgcagtgtagctgagtaacatcttttagctgactataaatcactttgttttt

SEQ ID NO: 261 - DNA, 230 bp, Homo sapien
ctgtactggatccctccaggtgggggcgactctcacctgactattacaatagcctcctaagtggtttccctacttgcaaccttgcccgtataatatctatcctccacacagcaggcagggcgatcctttaagaatagaagttagatcatgaaaatgctctgctctgatccctgcaaaagctcgccacctccttacagtcaccgctgaactcgtagcagaggttcaggagg

SEQ ID NO: 262 - DNA, 198 bp, Homo sapien
  misc_feature (1)...(198): n = A,T,C or G
atgttaagtaaacatgaaatctatataacagaacaaaaattcactcttatgtcaatgtcagcgtgttaatgtagatctatttactganacagactctgtagtggcagagagtggccttgttaagccaggaccctgttctgcaggctgtgggtagaagctaggaagtccctggagtttcacccagcttttccatgaatg

SEQ ID NO: 263 - DNA, 157 bp, Homo sapien
aaaatatatttctaaacagaatgggccgactcagtcacagtaactgttgatctccatagtagagcaacccacaaagacagaactgatttttttcccataatcaggggtgaaaaatatacaacttgtttctgaaccaaaaccacaatttctgcagttt

SEQ ID NO: 264 - DNA, 290 bp, Homo sapien
ctggctactccaagaccctggcatgaggctgaggacaacttacaagggcttcaccgaagcagtggacctttattttgaccacctgatgtccagggtggtgccactccagtacaagcgtgggggacctatcattgccgtgcaggtggagaatgaatatggttcctataataaagaccccgcatacatgccctacgtcaagaaggcactggaggaccgtggcattgtggaactgctcctgacttcagacaacaaggatgggctgagcaaggggattgtccagggagtcttgg

SEQ ID NO: 265 - DNA, 234 bp, Homo sapien
aaaaaaaggaaaggaaagagaggaaaagaaaataaaataagacgatttattgcttctcctcagcatcctccttggtctcctccttcaccgagagagcttctagcttttccgccactttttcggcatgatcatttttgcctgatcctttcttttctctctcttcgatctctttcctgcattcttcaaactttgttttgaatttctgtgcattctcagcattcaggaagcggatgg

SEQ ID NO: 266 - DNA, 335 bp, Homo sapien
gtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccagg

SEQ ID NO: 267 - DNA, 619 bp, Homo sapien
  misc_feature (1)...(619): n = A,T,C or G
tggagctctgacgaagggatcggggaggtgctggagaaggaagactgcatgcaggccctgagcggccanatcttcatgggcatggngtcctcccagtaccaggcccggctggacatcgngcgcctcattgatgggcttgtcaacgcctgcatccgctttgtctacttctctttggaggatgagctcaaaagcaaggtgtttgcanaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcanaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccanagaccatgtgtgagatgataaagatcatgcaanagtacggggaggtgacctgctgcctgggcanctctgcca

SEQ ID NO: 268 - DNA, 147 bp, Homo sapien
cctataacccagacaccagcatggacaaaactcagttatactgaattcagagacaaaattcagtgacactcttctaccacttatttagggttctacagcatttcactgagcagacttagttttttgtttttgttttacaaacctttt

SEQ ID NO: 269 - DNA, 325 bp, Homo sapien
ctgagctgtaggaatgggttcttggtacacaagatagtattgttgagctagttttcgagctctgtgcacaagcactctgtaatcggggcccatgccactgtacaccaaacctatatgcttggtaattggttctactttgtgtacacttcgctcatcatacagaatggatttctgttttttctcagttgctaataccacaccatttgcagctttaattcccacggacggggctcctccagctacagcagccaaagcatattcaatctggacaagtttaccagacgggctgaatgtagtcagcgaaaagctgtacccgcgctccgcc

SEQ ID NO: 270 - DNA, 428 bp, Homo sapien
aaacatatggtaaattaccgagtgacacctctgggctagagacctcttttgaggggagtttgcaaactacggattcaatttctttaacagttatgaagttctttaaagaacctgtttggtattggggggttgtggtcacctgtgcttttctgagatttggcccctacatctaagttgttgaatgcatgtgtgtagagttgtttatggtgcttccctttcttcttagaagggtctatagtaatatcccctgccttatccctagtagtactaatttgtgttttcttacttcttgacaggcaaacacatcagagcataagtggttcctaatgccaagctgacctcccttgatctctgtcttctacaggatattgacatgggacttctttattaccttttcagttcactgataccttcaaatagctttattt

SEQ ID NO: 271 - DNA, 206 bp, Homo sapien
  misc_feature (1)...(206): n = A,T,C or G
cgtcccggagcccacggnggncatggctggcanagcgctctgcatgctggggctggtcctggccttgctgtcctccagctctgctgaggagtacgtgggcctgtctgcaaaccagtgngccgtgccagccaaggacagggtggactgcggctacccccatgtcacccccaaggagtgcancaaccggggctgctgctttgactcca

SEQ ID NO: 272 - DNA, 83 bp, Homo sapien
ctggcttccctgagaactcaacaatgccttttcctgagggccttcctcgatcatccacaatgactacagccctctctacctgg

SEQ ID NO: 273 - DNA, 472 bp, Homo sapien
ctggagaaggtgtgcaggggaaaccctgctgatgtcaccgaggccaggttgtctttctactcgggacactcttcctttgggatgtactgcatggtgttcttggcgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctgctgtgagtccag

SEQ ID NO: 274 - DNA, 205 bp, Homo sapien
ccaggcggcccgaggacttacggtcggcacttctctgttctcccgtgtcagcgtgtggtgtcgcctgcatgggtcgtacctggatggtgtgtccaccatcgacacggaggggctggatttgtttctcaggcaatcctgtattttaattttagatgtatttcctgaagcatatttttcatagaatgtagcgtgtaaatagcttttt

SEQ ID NO: 275 - DNA, 308 bp, Homo sapien
ctcctcgccctccccaccgacatcatgctccagttccagcttggatttacactgggcaacgtggttggaatgtatctggctcagaactatgatataccaaacctggctaaaaaacttgaagaaattaaaaaggacttggatgccaagaagaaaccccctagtgcatgagactgcctccagcactgccttcaggatatactgattctactgctcttgagggcctcgtttactatctgaaccaaaagcttttgttttcgtctccagcctcagcacttctcttctttgctagaccctgtgttttttgcttt

SEQ ID NO: 276 - DNA, 201 bp, Homo sapien
aaattaactttttcttgcaaaatattcatttcattttttccaagaaaatcttataaaggcaaaaataaaattttattttggcaaatgtcatgaagtcgatactggcagcatatggagttagttaaaaatagacaacaactgctagatatattcaaaattctatttttttttctgagcatagtcaaagagaaattttcattt

SEQ ID NO: 277 - DNA, 520 bp, Homo sapien
  misc_feature (1)...(520): n = A,T,C or G
aaaaaaaaagtattcagcaccatttgctcatnggtctttcagagtttgttcttaaagtttctggaactttcctgtctgtaaagtaacaggaattactgagctacattggaaagcctctctgggacaggcagtggggagttaagcagtcatcataaaggaatcagtgtacattcagcatggtgacttgactacacaacaatcccttcccctctactgtagctcaagagagacatgcttctaaccactgaggtatgaggagtctcagactgttatttgctgttagaattggtcttcccagctaataacagtacatctctggcacagatgctattggtccttaatgtcctgtgattttaggaaatagtttggatttagttcaatttattcagaaaccaaacgtgtttaattagcttcactactctggcagagtaagggtatgctggtttagtatctttataaaatatatataatgtataggtaaatcatagtcttaaatcatacctaaaatactgtatcattt

SEQ ID NO: 278 - DNA, 264 bp, Homo sapien
cgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggccttgaagtaccatcctgataagaacccaaatgaaggagagaagttt

SEQ ID NO: 279 - DNA, 414 bp, Homo sapien
aaacatacaataatttttattatggaaattaatctttacatacaaaatcagctacgtaattttacttacaaaacaataaaaactgttctttactgtggcaacaaaagaagcattttgacaaatgaaaaaaattaatgcaaacaaattaaaacaatgcttttctttttacttgcttcactgtctcttctatttattttctatgatcatttgacacaaacatggattactttgatatctactgaaacataaatgataaggttcttaaaggttgaattaaaagtctgggtgttcaatattttagaagctgaataaacaaaacgaaattggggtttgtgattacagaggatttatcattttttccctttgtccatatgaaaatatataatagaaaattacccacgggaaaacattttt

SEQ ID NO: 280 - DNA, 262 bp, Homo sapien
ccaccatgcctggcctgcttcaattttttgatgccactttgtaaacggcacttaattatggaaaataggaaaaagcaaaactaaaataaggaagaggatatatatataacttttcacaatctcttttctgatcccctttagatgcccagtcaaccaggaccacacacagatttcattttatttgtagagtatatgaaaagatttaatagtctcatgcattttattttacgtatactgatttctacgttttgactgactattt

SEQ ID NO: 281 - DNA, 349 bp, Homo sapien
ctgtgacccgggtgcatcagtggatatagttgtgtctccccatgggggtttaacagtctctgcccaagaccgttttctgataatggctgcagaaatggaacagtcatctggcacaggcccagcagaattaactcagttttggaaagaagttcccagaaacaaagtgatggaacataggttaagatgccatactgttgaaagcagtaaaccaaacactcttacgttaaaagacaatgctttcaatatgtcagataaaaccagtgaagatatatgtctacaactcagtcgtttactagaaagcaataggaagcttgaagaccaagttcagcgttgtatctggttccagcag

SEQ ID NO: 282 - DNA, 381 bp, Homo sapien
  misc_feature (1)...(381): n = A,T,C or G
aaacactaaatgaagcttctcacaatttctaattataaacaaaaggctgaaaacagtatgggaaacaaagtttcaaaacaaagaaaagttgagtaaaaggtgccccctctatggctcatctgaaagaaacattttactcagagaggcaaacatttctgatctaggagtaagtttcccactcactttgcaaggacccactcattctgcanaaagacctacaagtctttctggtctcaattgcaaagtacgtgaaaatgtgtatgaaagatctaaaagctaaatattagaataaggctaattgaaatcaaaattgtgtgctggtctaaatatacatcttcggcttcttcctttttagtaagtatttttatttcagatgtattt

SEQ ID NO: 283 - DNA, 543 bp, Homo sapien
aatatagctcctccctacccccaacaatggaccctgcccattgcctcccagttccttgatcttcctaggttccacaactctctttttccttttagttttattccctccagccaaacctctcttattcaatattttgagccaatgggggagttatgtagatttttttccctacacattagctggccccttttatgaccaatgactcataaggcaagatgtgtggtggcatcttcggacaggcagcaggctttaatagggcagcctgggttggtggaggcaagcaaagctaattggcatgcgtgggaatcaaaccccaggccctgggctcattagcccatggtcaaaacaactgagccagaggaggtaataatttgcccaagaatatcagtagttcctttattagaagaaaatggctgatatggaagttggggaatctgaattgccagagaatcttgggaagagtaataagctcttagtctcaacaaaaagtgttttttcatctcagcgcgtaaagggtgctatatgggaacaaagaagtatttt

SEQ ID NO: 284 - DNA, 147 bp, Homo sapien
aaactggtattttatctttgattctccttcagccctcacccctggttctcatctttcttgatcaacatcttttcttgcctctgtccccttctctcatctcttagctcccctccaacctggggggcagtggtgtggagaagccacagg

SEQ ID NO: 285 - DNA, 316 bp, Homo sapien
cggccgaggtctggcttcactcctactccctctctgctcgcagcacgtcggccgccagctctttgatgtgttcccaggcccgctgcacatgggcagattccaccgtgcgagaacagatggcaaagcgcaggacaaacttgtccctgaggtgacatggaaccaagtggatttttttggcactgtttattctttgcagaagagcttcattcactttgttggaaccctttagccgaaagcagacaagccccagaatgacttccacacagatttcaaagcggggatcctggcgcaccagtgactcaaactcatgggacag

SEQ ID NO: 286 - DNA, 322 bp, Homo sapien
cctggggagccctttagtggggtgggacctcaggcagacccccaaaccaaagggagccagatgcccaagttcaagtcattagtgatatgtggcagggctgacagagaaataatcctggaggtctccaaagctgctgggaatggaatggcgatgaaaagcgcaggagtgggcagggtgtggtgggtgatggtggcctcactcagagtggaccaaggccccagctccttgcccaaaaccaaagcccttgggcccgaagtttttagcataacatcctttgcagtaaatctcgccatccttgtctgccagggtggttgactcaagg

SEQ ID NO: 287 - DNA, 364 bp, Homo sapien
ctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagagg

SEQ ID NO: 288 - DNA, 261 bp, Homo sapien
aaaattataactactcattctttctttagccttagttaatttgagcagaagccacaacaagcaaaccacaataaatttagaattggcagaaatccacattaactcctcttcccaagtttccacactactaccatttacagttgtaggtttgtaatgtataattatgtaatgcagaaactagctttgacttgtgtaacgatgcactgtcaaagtaagcaaagtaagaattgaaattccacattcccagaatttaacactcag

SEQ ID NO: 289 - DNA, 261 bp, Homo sapien
ctgagtgttaaattctgggaatgtggaatttcaattcttactttgcttactttgacagtgcatcgttacacaagtcaaagctagtttctgcattacataattatacattacaaacctacaactgtaaatggtagtagtgtggaaacttgggaagaggagttaatgtggatttctgccaattctaaatttattgtggtttgcttgttgtggcttctgctcaaattaactaaggctaaagaaagaatgagtagttataatttt

SEQ ID NO: 290 - DNA, 92 bp, Homo sapien
ccactacccgaacttacaggtgccaaaagaagaaagggtataaacggagaccacctatcactcatcagaacctaggatcatcacattccttt

SEQ ID NO: 291 - DNA, 287 bp, Homo sapien
ccatggctccgctcagggccccggtcacctccgagtcactctgttccttgactgtctttgtgtttctgtacctcaaggcactgaagctggaggactctgtccatgcctgtgtcaccctcgtgtgggagcctctgggctcggcaggtccacatttcatgagctgaggcgtgggccagggccatctggaaagggaactcggcttttccagaacgtggtggatcatctgtcgggtgtgtggtgaacacgttcagttcatcagggcctacgctccgggaaggggcccccag

SEQ ID NO: 292 - DNA, 270 bp, Homo sapien
ccattgtttcctcgctggcgaaggctccttgaacatccctcaccttcctctcccgcctctgccttctgctgggtcaaaggtggccttttctctccagccttgaattgttccctgttggcttcccaagggcccatctgctggtacagtccacacttccacagccaagacccgagagggctttcactgccccaagcctctctcctgtgaccctgggattctgtcttggcagaatcctttgtcagcggctcttactctgtccttcctgtttgg

SEQ ID NO: 293 - DNA, 333 bp, Homo sapien
ccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagagg

SEQ ID NO: 294 - DNA, 123 bp, Homo sapien
ctgatacaaatacagaaaactctgcccattatccaagaaacaaataattaagactaaaatgcaagctgatgtgttgcagcattgtagggccactaaatagccatctgtgattcgtggcaattt

SEQ ID NO: 295 - DNA, 311 bp, Homo sapien
ctgcatacagacatttgtttaggtcatctggattatcttgattgtcaccatggcaactatccacaaccagtgcctaggtgtgtgagaagagtgatacaataatactgtggcatggtcatttagctaatccagtctaagcctaacagaaaccttttccatcaaagtttttcagagaataacaacatctcataagaggccagaggatggcttgtgcttaatatcacacctgtacagtagggcagtgcttcccaggctgtctgcttacattttagcttgtcttacggttacatatggttttagtattttcattt

SEQ ID NO: 296 - DNA, 241 bp, Homo sapien
ctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggcttta

SEQ ID NO: 297 - DNA, 295 bp, Homo sapien
aaacacaagatgaaaatactctgttctgtccaaagcatcacctaatggtgtgaggcatctcacttagctgtggagaagtccttggaattagatctcagaaagacagctttaagacagtaaaaccttttggcaatgggctaattgccttaaaagaagagttctacctgaaagaccttgcaggtggagaaattgtcctacaaagattcttggatatgttagtggagataactgacatgggtagctgtgggtcaaccaggaactgtcaacaacctgatctctgcaaaaccaggatgga

SEQ ID NO: 298 - DNA, 347 bp, Homo sapien
ccaaaataaagcttcaggcaagaggcaaagatccagtggaatatgggagaatggtggaggaccaacacctgctaccccagagagcttttctaaaaaaagcaagaaagcagtcatgagtggtattcaccctgcagaagacacggaaggtactgagtttgagccagagggacttccagaagttgtaaagaaagggtttgctgacatcccgacaggaaagactagcccatatatcctgcgaagaacaaccatggcaactcggaccagcccccgcctggctgcacagaagttagcgctatccccactgagtctcggcaaagaaaatcttgcagagtcctccaaaccaacag

SEQ ID NO: 299 - DNA, 268 bp, Homo sapien
aaaaagtaaacatgaaaacatcacgaattgtaccatgattcaagaataacttttgtaatagaaaacacatgaccttttgcagtatagtgtgataccgaagtaaaagtgaaagaaataaatgcaggaaagtttaagtggatgtaagtttttataaggaaagtaataagaggaggctgcttttgaaggtcctttgatcttccatgatgataatatcgttgcaaagttctttaacttgtattcaagtaattagcagttgaccacttggttt

SEQ ID NO: 300 - DNA, 185 bp, Homo sapien
aaattggagaaggaagttttcctgaagagccagaatccttgctaagtcatttagatccaactgaccatctttatttctgtcaaaaatcttcatcatggtgccggtgtattcttccagtttagcctcagaaatggcctttctgtggtgaagaaagaggtctcggaggaagttgcggagctcagcag

SEQ ID NO: 301 - DNA, 75 bp, Homo sapien
aaaattggaaagtgggataagaaatctaaagtaaccagcttatctttgaaacaatattattttgaaattggcttt

SEQ ID NO: 302 - DNA, 247 bp, Homo sapien
  misc_feature (1)...(247): n = A,T,C or G
ccatgttctctgaattgggtgcagaagacaagggcagagtggctgcggcccctattacctttgtagcagccacatcagaaagcagaagaaaacagtatttctgaaggcattgtttgaggttgatctcagcactgaacgatttcaagccctacgcaccanaacagaaggagggtggaggaagtgatcanagggaacgagctgtaggtttgcanaaatgtgtgaaaccaaaatgatcactgcctacttg

SEQ ID NO: 303 - DNA, 535 bp, Homo sapien
ctgcttcagaggaaatcactgaaaaataaagaaaaaccatccatgcatggctgcatccagtgtacctgtaatcctgaagaaaaggtcctaattccttccatgctgaaatgctagctttggtttcagagagagactttattgcaactgtgaccaccgtcactggtgagcactgctgttcggcccccagcggacttaaaagactggaatgtggtagtggcggtcgttctcggtcagcagggagatctccggccagtccctgagaggctcctctgggtagcagacttcaaagtctctggagttaaacttgaacagtctgaacacttttatctttacttcaagggagtatccaagtataaacatatcaatctgctctagtccacatgtgtcgcctacagaattcaggtgattcatcatgaagctcaaaggatcagaggatgtctccctggaaaacaggagtctaaaaagactgggaatgacctttttagtcttcatttgttcataaacttcagtgacttgatacagcatgatgaacttt

SEQ ID NO: 304 - DNA, 522 bp, Homo sapien
ccgcgctcggtctacaatcacgttttattattggctcgtctagtcatgggatagagaaggtaaatagcaaaatagaaagaaaagggggaaaaggtagaaggcaaggggaaaactattggttttagatctttatcctggtcctgtcaatgatcaggtaattggaaggatcaaaattaggccaaacttggtaattgggccaaaattgaaccaaagtttgtgtcaagaagacctggggcagagatatgtgactaaatcatttggaatatgcccagaccccaagaatatttatgcccaacttgaatgctaaccagaagtcccttactgtagaagattgtaaggttgctatttttttgccccgacaccaaaatattgatgtattttccaacaccaattctccaattctctgacaccaactcgatgttcaacaattcagttatattctgtcactaattcctgcagctatcagcaggccccacaggtaaaggattcagtctcacaagattgcccccccacccacttcag

SEQ ID NO: 305 - DNA, 165 bp, Homo sapien
cctaaagcgctcctcgctgaagctcaaggggtccacaatgatttgtttgtcaaagttattgagtgcatatgccagttctcctcctcctccaccctggtgctgtgaggcatcgtctgaggcagtggcctgggctgcattggaaatgcctgtgaccgcctgctgcag

SEQ ID NO: 306 - DNA, 294 bp, Homo sapien
ctgcacctaagacatggccctggctaggcgggaacagctcacagtagcgatacattcacaggacacagttggtgtccagaaaagggggctcagaacacagtttctacacaagcacttggcacccacacgacagagacgtcactcaagcagcacagccacaaatagtttacagcagctcatgcccggcatccgcccatgctgggagactccctgaaaggtgggcacctgccgtctatgaggaggtgtctccctccatcattaaccccaaaccacacaatgtgtgaggagagcagg

SEQ ID NO: 307 - DNA, 181 bp, Homo sapien
aaaaatccatgacaccttgatagaaattagagtttacacaaacaaaaaaggaaccttcgatattgccagcagctataaagtgaacgtactgagaccgacaggacagcaagaaggcatttgcacatttatatctgacacccgaccatactttcagtcaccagaatatcttctctccagattt

SEQ ID NO: 308 - DNA, 179 bp, Homo sapien
  misc_feature (1)...(179): n = A,T,C or G
aaggctgaggactgctgggagctcagatcagcccggagctactggctcatgggcagccaaaaaatactggatctgctgaacgaaggctcagcccgagatctccgcagtcttcagcgcattggcccgaagaaggcccanctaatcgtgggctggcgggagctccacggccccttcagcca

SEQ ID NO: 309 - DNA, 129 bp, Homo sapien
  misc_feature (1)...(129): n = A,T,C or G
ctgcccgcttgcccgtagctgactcagnttcctcatcttcatctccatcctcttcctcaccatcaccttcttcttcctcctcctcttcctccccaccttcttcctcttcttcgtctacctcattgtcag

SEQ ID NO: 310 - DNA, 390 bp, Homo sapien
tgaggctgggggagagccgtggtccctgaggatgggtcagagctaaactccttcctggcctgagagtcagctctctgccctgtgtacttcccgggccagggctgcccctaatctctgtaggaaccgtggtatgtctgcatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaagg

SEQ ID NO: 311 - DNA, 355 bp, Homo sapien
  misc_feature (1)...(355): n = A,T,C or G
cctctctgtgctgctgaaggcagatcgcttgttccacaccagctaccactcccaggcagtgcatatccgcctgttgagaaatgccgtgtctagattgtggacaagagcctgcgtgattatgctatangganaaaaattcttcgagttccacccnanctcctctaaacatttggctcactcaaaacaaaaagncaccaatcttantactgctgaacttcatttatgtnacctaacattaaccntcgtaggaaaaccaaatagccctctcgtncangatatgttgctaaaggactaccntgttcaacacaacggctccggtgtgtgaactcctgtttgggtgattcccctactctca

SEQ ID NO: 312 - DNA, 498 bp, Homo sapien
ccattcttttgaatctaatctattatcaatagcatcctccataatatctttgataaaaggtgtccaccgagagagctgaaaagtttcttctgcagaccgatcctttcttaacggtttgccttgttgagattggggaacaatgggaacaccaaggtaactccagttacgaatcatgtcactctcattttctatctttacattctggatcaacctgtccaaattttcttccgtagttccattaatactgaagatataaagtagaattgctcttattttatcacaattatcatgatttttgttgagtagaactggaaggagtactcgcatggaatctttcaccttctgtccttctgcatcagttccaagtgccaggtcctgttcagttttgcagagcttttctatattaagcttgaacttattcatgcaatcttctgctaagttaagatggacaacttgcttagtaatctgttttcggaaatagggcatctttttcatcag

SEQ ID NO: 313 - DNA, 653 bp, Homo sapien
aaacttatcagatttttttaagttaggtaatttcaatccacagtggctccatatggttaaaaaaacaaaaacaaaaacgcatttaaggatacacgaagcagtgaaaacaaagccccagtattttcgctaaagtactggaaatacctgtttctaaaaacagctttatatttgtccactgcctagaatagctctcacccaaacctcaaaaataagagcagatagattttagaagcaagaaaaggtaaacagtgcccatattatttgagactggctctgctgccctccctaagccagtttacattctttgagattcttggagtgggtgagtcagggctgaagactgcacaggccatgtcccctgctccaactattcctcagaacgtcccaggtggagggagtggcctgtcgattttcactcattccatggagctctgtgtacatgaaaattcctccaagtgtggcttttgtcgaattcagagatacagcaagccacgcataaaacatggagtgtagagcactggtgtacctagcttagaaacaccctcggtgaatgtggtactgtggctcgaaaggaagcaagggacaggacccaggagactgggcggccaggctctcggagttccacacacacctgtgaagcccggccagcacag

SEQ ID NO: 314 - DNA, 513 bp, Homo sapien
ctggaagattttgctgcatttggcattatactgtaatttacagtatacaacatctggggactcagtactatcttagcacagactaacttctcccactccgtcagaggtggcaggtggcgggtcggtggggagggccttttctccccataaatgcctgaactttaatttataccatataagaaatcagtgaaaggtaaacaacaaggttaatgtaactctattataaattttgcattttttttctctgtgacatatacaagtatatttttgtttttggagctataaattatttaatttagcaatcttcaaagctcataaatttcaacttttcaaataagaaattttaacttcaaataagaagtctaggactttatggctattaattttactatcaaaatatccaagggactccattcaatgtaatagttataattcttctaaatatcatttgaataattctttgtggacgctagactcaagactatgctacatccaaacagtacatctataacc

SEQ ID NO: 315 - DNA, 222 bp, Homo sapien
  misc_feature (1)...(222): n = A,T,C or G
atttatattcaaggnatctcaaagaaagcattttcatttcactgcacatctagagaaaaacaaaaatagaaaattttctagtccatcctaatctgaatggtgctgtttctatattggtcattgccttgcaaacaggagctccacaaaagccaggaagagagactgcctccttggctgaaagagtcctttcaggaaggtggactgcattggtttgatatgttt

SEQ ID NO: 316 - DNA, 1633 bp, Homo sapiens
cgtggaggcagctagcgcgaggctggggagcgctgagccgcgcgtcgtgccctgcgctgcccagactagcgaacaatacagtcgggatggctaaaggtgaccccaagaaaccaaagggcaagacgtccgcttatgccttctttgtgcagacatgcagagaagaacataagaagaaaaacccagaggtccctgtcaattttgcggaattttccaagaagtgctctgagaggtggaagacggtgtccgggaaagagaaatccaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaacaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatatttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttagaactcttctctactataacagtcaatttctgactcacagcagtgaacaaacccccactccgttgtatttggagactggcctccctataaatgtg

SEQ ID NO: 317 - DNA, 4235 bp, Homo sapiens
gaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcagtggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatgttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagtgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatatcttagactcgatgctgtataaaatattatgggaaaaaagaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacattatttcttggtttccacttgcaatggttaattaagtccaaaaacagctgtcagaacctcgagagcagaacatgagaaactcagagctctggaccgaaagcagaaagtttgccggaaaaaaaaagaccacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataagaaaactgaaatatgtcttcaaaaaaaaaaaaaaaaaaaaaaaaaaaaaaaaaaaaaaaaaa

SEQ ID NO: 318 - DNA, 3347 bp, Homo sapiens
atcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagcccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgtgggtaagttgaggttatcttgggataaagggtcttctagggcacaaaactcactctaggtttatattgtatgtagcttatattttttactaaggtgtcaccttataagcatctataaattgacttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaacccaacaacagcttttaaagtgtcttctatctcattgtattttttttaacttgccccaatgatagaaaagtcttttgctgaaatgattttgatgatttttgtttatcgtttataaaaaggaaaagaaatatacaaactttgacttttgtgaaaaaaaaaaaaaaaaaaaaa

SEQ ID NO: 319 - DNA, 1814 bp, Homo sapiens
ggggagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaagctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggcgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagctt

SEQ ID NO: 320 - DNA, 3132 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaacggtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtatcccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaaaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttcttttttttttttgaaagtgttttttcttcgtccttttggtttaaaaagtttcacgtcttggtgccttttgtgtgatgccccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtagctgcgattggg

SEQ ID NO: 321 - DNA, 2280 bp, Homo sapiens
ccgcccgccaccagctacgccccgtccgacgtgccctcgggggtcgcgctgttcctcaccatccctttcgccttcttcctgcccgagctgatatttgggttcttggtctggaccatggtagccgccacccacatagtataccccttgctgcaaggatgggtgatgtatgtctcgctcacctcgtttctcatctccttgatgttcctgttgtcttacttgtttggattttacaaaagatttgaatcctggagagttctggacagcctgtaccacgggaccactggcatcctgtacatgagcgctgccgtcctacaagtacatgccacgattgtttctgagaaactgctggacccaagaatttactacattaattcggcagcctcgttcttcgccttcatcgccacgctgctctacattctccatgccttcagcatctattaccactgatgcacaggcgccaggccaagggggaaatgctctttgaaagctccaattattggtccccaaaagcagcttccaacgtttgccatctggatgacaaacggaagatccactaaaacgtccacgggattaacagaacgtccttgcagactgagcgatgacaccacactttgtttggacatttaaattcactctgctgaataggaggaagcttttctttttcctgggaaaacaactgtctcttggaattatctgaccatgaacttgctcttctagacaactcacatcaaagccctcactccactaatggagaatcctagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccatgcccggctaatttagttgtatttttagtagagatggggtttcaccgtattagccaggatggtctcgatctcctgacctcgtgatccgcccgcctcggcctcccaaagtgctgggattacaggcgtgagccaccgtgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatctgcatgaagccaattttgagggtagacgtgtggggaaaataaatcattatacagtaagacctggggcttgaggggtggggaatggggagggaagggcatagcctgctcctccatgagtctgacatctcggaaactgagcagctgccggacgcctgggtcaggaatccaagaccccacctcttaaggactggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggctggcggaatggtggtgcccacggggttgggcaagggctcaccaggacctcaacgggcaaagttgtgcacactaaaatatcaaatcaaggtgcttggttttaaagtaaatgtttttctaaagaaagctgtgttcttctgttgacccagacgaatagggcacagccctgtaactgcacgtgccttctgtcattgggaatgaaataaattattacgagaaagggacttgtcctaactggtttgaggccttacagttttgtatctacatttttcccctcctggggtttgcggggacagggacagaactacaggagtcatgggaaagaaaattctggcttcactactgctcactgctcactttctgatcactctgatactttttttttttttttttttttgcaacctgataccttgaaaagcttctatgtgtctctccttttgttgcctggcagctgtctaggatgatcactgattactatttactaagtagccacatgcaaataaaagttgtttggtaaaatggaaaaaaaaaaa

SEQ ID NO: 322 - DNA, 1398 bp, Homo sapiens
tagatggcaacctccctatctgcccgcaggtcatagaggcgacacgtagcgtcatctgaccctgaagcaaaggcatctccactccaaagttagacaaaatgccaggaatgttcttctctgctaacccaaaggaattgaaaggaaccactcattcacttctagacgacaaaatgcaaaaaaggaggccaaagacttttggaatggatatgaaagcatacctgagatctatgatcccacatctggaatctggaatgaaatcttccaagtccaaggatgtactttctgctgctgaagtaatgcaatggtctcaatctctggaaaaacttcttgccaaccaaactggtcaaaatgtctttggaagtttcctaaagtctgaattcagtgaggagaatattgagttctggctggcttgtgaagactataagaaaacagagtctgatcttttgccctgtaaagcagaagagatatataaagcatttgtgcattcagatgctgctaaacaaatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaaggcacgaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacaggctgtaagaatcaaagtcaactgacatctatgctacatattattatatagtttgtactgagctattgaagtcccattaacttaaagtatatgttttcaaattgccattgctactattgcttgtcggtgtattttattttattgtttttgactttggaagagatgaactgtgtatttaacttaagctattgctcttaaaaccagggatcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaaaaaaaaaaa

SEQ ID NO: 323 - DNA, 1316 bp, Homo sapiens
acttctacctgctcactcagaatcatttctgcaccaaccatggccacgtttgtggagctcagtaccaaagccaagatgcccattgtgggcctgggcacttggaagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaggagatggcaaccatactcagcttcaacagaaactggagggcctgtaacgtgttgcaatcctctcatttggaagactatcccttcaatgcagaatattgaggttgaatctcctggtgagattatacaggagattctctttcttcgctgaagtgtgactacctccactcatgtcccattttagccaagcttatttaagatcacagtgaacttagtcctgttatagacgagaatcgaggtgctgttttagacatttatttctgtatgttcaactaggatcagaatatcacagaaaagcatggcttgaataaggaaatgacaattttttccacttatctgatcagaacaaatgtttattaagcatcagaaactctgccaacactgaggatgtaaagatcaataaaacaaataataatcataaaaaaaaa

SEQ ID NO: 324 - protein, 200 aa, Homo sapiens
MAKGDPKKPKGKTSAYAFFVQTCREEHKKKNPEVPVNFAEFSKKCSERWKTVSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDVADYKSKGKFDGAKGPAKVARKKVEEEDEEQEEEEEEEEEEEDE

SEQ ID NO: 325 - protein, 263 aa, Homo sapiens
MFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 326 - protein, 539 aa, Homo sapiens
MPENVAPRSGATAGAAGGRGKGAYQDRDKPAQIRFSNISAAKAVADAIRTSLGPKGMDKMIQDGKGDVTITNDGATILKQMQVLHPAARMLVELSKAQDIEAGDGTTSVVIIAGSLLDSCTKLLQKGIHPTIISESFQKALEKGIEILTDMSRPVELSDRETLLNSATTSLNSKVVSQYSSLLSPMSVNAVMKVIDPATATSVDLRDIKIVKKLGGTIDDCELVEGLVLTQKVSNSGITRVEKAKIGLIQFCLSAPKTDMDNQIVVSDYAQMDRVLREERAYILNLVKQIKKTGCNVLLIQKSILRDALSDLALHFLNKMKIMVIKDIEREDIEFICKTIGTKPVAHIDQFTADMLGSAELAEEVNLNGSGKLLKITGCASPGKTVTIVVRGSNKLVIEEAERSIHDALCVIRCLVKKRALIAGGGAPEIELALRLTEYSRTLSGMESYCVRAFADAMEVIPSTLAENAGLNPISTVTELRNRHAQGEKTAGINVRKGGISNILEELVVQPLLVSVSALTLATETVRSILKIDDVVNTR

SEQ ID NO: 327 - protein, 144 aa, Homo sapiens
MAFTFAAFCYMLALLLTAALIFFAIWHIIAFDELKTDYKNPIDQCNTLNPLVLPEYLIHAFFCVMFLCAAEWLTLGLNMPLLAYHIWRYMSRPVMSGPGLYDPTTIMNADILAYCQKEGWCKLAFYLLAFFYYLYGMIYVLVSS

SEQ ID NO: 328 - protein, 138 aa, Homo sapiens
MPNFSGNWKIIRSENFEELLKVLGVNVMLRKIAVAAASKPAVEIKQEGDTFYIKTSTTVRTTEINFKVGEEFEEQTVDGRPCKSLVKWESENKMVCEQKLLKGEGPKTSWTRELTNDGELILTMTADDVVCTRVYVRE

SEQ ID NO: 329 - protein, 346 aa, Homo sapiens
MFLSILVALCLWLHLALGVRGAPCEAVRIPMCRHMPWNITRMPNHLHHSTQENAILAIEQYEELVDVNCSAVLRFFFCAMYAPICTLEFLHDPIKPCKSVCQRARDDCEPLMKMYNHSWPESLACDELPVYDRGVCISPEAIVTDLPEDVKWIDITPDMMVQERPLDVDCKRLSPDRCKCKKVKPTLATYLSKNYSYVIHAKIKAVQRSGCNEVTTVVDVKEIFKSSSPIPRTQVPLITNSSCQCPHILPHQDVLIMCYEWRSRMMLLENCLVEKWRDQLSKRSIQWEERLQEQRRTVQDKKKTAGRTSRSNPPKPKGKPPAPKPASPKKNIKTRSAQKRTNPKRV

SEQ ID NO: 330 - protein, 826 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 331 - protein, 92 aa, Homo sapiens
MAYRGQGQKVQKVMVQPINLIFRYLQNRSRIQVWLYEQVNMRIEGCIIGFDEYMNLVLDDAEEIHSKTKSRKQLGRIMLKGDNITLLQSVSN

SEQ ID NO: 332 - protein, 235 aa, Homo sapiens
MDPARPLGLSILLLFLTEAALGDAAQEPTGNNAEICLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSPKDEGLCSANVTRYYFNPRYRTCDAFTYTGCGGNDNNFVSREDCKRACAKALKKKKKMPKLRFASRIRKIRKKQF

SEQ ID NO: 333 - protein, 291 aa, Homo sapiens
MQRARPTLWAAALTLLVLLRGPPVARAGASSGGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 334 - protein, 582 aa, Homo sapiens
ESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 335 - protein, 709 aa, Homo sapiens
MAEVEDQAARDMKRLEEKDKERKNVKGIRDDIEEEDDQEAYFRYMAENPTAGVVQEEEEDNLEYDSDGNPIAPTKKIIDPLPPIDHSEIDYPPFEKNFYNEHEEITNLTPQQLIDLRHKLNLRVSGAAPPRPGSSFAHFGFDEQLMHQIRKSEYTQPTPIQCQGVPVALSGRDMIGIAKTGSGKTAAFIWPMLIHIMDQKELEPGDGPIAVIVCPTRELCQQIHAECKRFGKAYNLRSVAVYGGGSMWEQAKALQEGAEIVVCTPGRLIDHVKKKATNLQRVSYLVFDEADRMFDMGFEYQVRSIASHVRPDRQTLLFSATFRKKIEKLARDILIDPIRVVQGDIGEANEDVTQIVEILHSGPSKWNWLTRRLVEFTSSGSVLLFVTKKANAEELANNLKQEGHNLGLLHGDMDQSERNKVISDFKKKDIPVLVATDVAARGLDIPSIKTVINYDVARDIDTHTHRIGRTGRAGEKGVAYTLLTPKDSNFAGDLVRNLEGANQHVSKELLDLAMQNAWFRKSRFKGGKGKKLNIGGGGLGYRERPGLGSENMDRGNNNVMSNYEAYKPSTGAMGDRLTAMKAAFQSQYKSHFVAASLSNQKAGSSAAGASGWTSAGSLNSVPTNSAQQGHNSPDSPVTSAAKGIPGFGNTGNISGAPVTYPSAGAQGVNNTASGNNSREGTGGSNGKRERYTENRGSSPSQSRRDWQSA

SEQ ID NO: 336 - protein, 480 aa, Homo sapiens
MIRAAPPPLFLLLLLLLLLVSWASRGEAAPDQDEIQRLPGLAKQPSFRQYSGYLKSSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 337 - protein, 543 aa, Homo sapiens
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 338 - protein, 148 aa, Homo sapiens
PPATSYAPSDVPSGVALFLTIPFAFFLPELIFGFLVWTMVAATHIVYPLLQGWVMYVSLTSFLISLMFLLSYLFGFYKRFESWRVLDSLYHGTTGILYMSAAVLQVHATIVSEKLLDPRIYYINSAASFFAFIATLLYILHAFSIYYH

SEQ ID NO: 339 - protein, 196 aa, Homo sapiens
MPGMFFSANPKELKGTTHSLLDDKMQKRRPKTFGMDMKAYLRSMIPHLESGMKSSKSKDVLSAAEVMQWSQSLEKLLANQTGQNVFGSFLKSEFSEENIEFWLACEDYKKTESDLLPCKAEEIYKAFVHSDAAKQINIDFRTRESTAKKIKAPTPTCFDEAQKVIYTLMEKDSYPRFLKSDIYLNLLNDLQANSLK

SEQ ID NO: 340 - protein, 316 aa, Homo sapiens
MATFVELSTKAKMPIVGLGTWKSPLGKVKEAVKVAIDAGYRHIDCAYVYQNEHEVGEAIQEKIQEKAVKREDLFIVSKLWPTFFERPLVRKAFEKTLKDLKLSYLDVYLIHWPQGFKSGDDLFPKDDKGNAIGGKATFLDAWEAMEELVDEGLVKALGVSNFSHFQIEKLLNKPGLKYKPVTNQVECHPYLTQEKLIQYCHSKGITVTAYSPLGSPDRPWAKPEDPSLLEDPKIKEIAAKHKKTAAQVLIRFHIQRNVIVIPKSVTPARIVENIQVFDFKLSDEEMATILSFNRNWRACNVLQSSHLEDYPFNAEY

SEQ ID NO: 341 - DNA, 422 bp, Homo sapien
  misc_feature (1)...(422): n = A,T,C or G
gatganattnttncnagagagaggaagangctattcagttggatgggattaaatgcatcacaaataagagaacttagagagaagtcggaaaagtttgccttccaagcccgaagttaacagaatgatgaaacttatcatcaattcattgtataaaaataaagagattttcctgagagaactgatttcaaatgcttctgatgctttagataagataaggctaatatcactgactgatgaaaatgctctttctggaaatgaggaactaacagtcaaaattaagtgtgataaggagaagacctgctgcatgtcacagacaccggtgtaggaatgaccagagaagagttggttaaaaaccttggtaccatagccaaatctgggacaagcgagtttttaaacaaaatgactgaagcacaggaagatgg

SEQ ID NO: 342 - DNA, 472 bp, Homo sapien
  misc_feature (1)...(472): n = A,T,C or G
ctggagaaggtgtgcaggggaaaccctgctgatgtcaccgaggccaggttgtctttctactcgggacactcttcctttgggatgtactgcatggtgttcttggcgctgnatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcctcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctactgtgagtccag

SEQ ID NO: 343 - DNA, 139 bp, Homo sapien
gtcctgggccttccccttccctcaagccagggctcctcctcctgtcgtgggctcattgtgaccactggcctctctacagcacggcctgtggcctgttcaaggcagaaccacgacccttgactcccgggtggggaggtgg

SEQ ID NO: 344 - DNA, 235 bp, Homo sapien
ctgcgggctcagcacagtagacatgactgggatccccaccttggacaacctccagaagggagtccaatttgctctcaagtaccagtcgctgggccagtgtgtttacgtgcattgtaaggctgggcgctccaggagtgccactatggtggcagcatacctgattcaggtgcacaaatggagtccagaggaggctgtaagagccatcgccaagatccggtcatacatccacatcagg

SEQ ID NO: 345 - DNA, 458 bp, Homo sapien
ctgtaaggtgctattcagtcctgtgacccttattttggaatgctcttcattactgttgctctgttttgtgacttcctgggaaaccgcctactttggtgtggtgtcaccttgagctgtgcacataggacaccagttttgacttaacctaacaggcagtttttatctctagctttttcaagccaggtattgagcagtttcttggccaatggcctgagaaaccacctgtccctgtcaaggggtgattttattggttttaagtggggaagtaatcccatgtacttatttcttaaatacctaggaagttcttcttggtggctcctcttggccctcccctctttctcccccaacccaccatcctgcaaggcaaggaatggcctctccctccacagaggcaacggctgcagagggagcactgtggctgccatcccagttcctcttcaaagccaaacagacacgcg

SEQ ID NO: 346 - DNA, 525 bp, Homo sapien
  misc_feature (1)...(525): n = A,T,C or G
ccagagcacaacgcctcaccatggactggacctggaggatnntcttnnnggtggcagcagccacaggtgtccactcccaagcccaacttgtgcagtctggggctgaggagaagaagcctggggcctcagtgactatttcttgtaaggcttctggatatatncttactaaatatactttacattgggtgcgccaggccccccccggacaaagacctgaatgggtgggatggatcaacactggcattgataccgttaaatattcacagaagtttcaggacagagtctccattacctgggactcatccgcgaccacagnctacctgnanntgagtagcctggaatccgaagacacggctgtgtattactgtgcgagacttanggcccgttcgctgtggtgggacttaatgacgcttttgacatctggggccaagggacagtggtcaccgtctcttcanggagtgcattcgccccaacccttttccccctctctcctgtgaagaattccccgncggatacgagcagcgt

SEQ ID NO: 347 - DNA, 423 bp, Homo sapien
ccagacgctgacttgtttctgagtccttaagcaggaaggatttgaaatcctggagcttggcagtcttgctcttcacctctaagccaatgttgaccccttcatctataaagtccacaactctccggaagtcatcctcacggaactgtcgagaagttaaggctggggccccaagccgcaggccgcccggtgtgatggcacttcggtctccaggacaggtgttcttgttggcagtgatggatacaagctctagcacccgctcagcccgagctccatccaggcccttgggccgcaggtccaccagcaccaggtggttgtcagtaccacctgataccagtgagtagcctcgctctagcagggcatctgccatggcccgagcattcttcagaacctgcagggagtactcccggaacatgggggtgcagg

SEQ ID NO: 348 - DNA, 513 bp, Homo sapien
cctctaggcctgatgctctcagaggcaatagaagaaaagtaaaaggaaggtctcacttcacagacaatgaaaccctcctaaccctcttccccactacccacaactccctacactgccaatctaaataaaaagaggacaatgcatgagtgtgagatacacatacacacacacacatacacacacacacacgcacagcttcctttcagccaaagaactgcaaaatccttccccggaaggaggacaactggcaacaccaatcaaggcttggtggtctaaggtgatggctggaatcatgtgagactggtaaaaatccagggagaaaatgtttcaccttcagctcattcccaagtctctatgaagcccgccccacttccacataggggaactgtggctctgggggcagcctctgcagctactcagaataggtgggaggaggggctggctttgaggctgccttagccatgaggctctttgcctaggaatagctggagatgggagctgcagggggctcag

SEQ ID NO: 349 - DNA, 231 bp, Homo sapien
ccttatttctcttgtcctttcgtacagggaggaatttgaagtagatagaaaccgacctggattactccggtctgaactcagatcacgtaggactttaatcgttgaacaaacgaacctttaatagcggctgcaccatcgggatgtcctgatccaacatcgaggtcgtaaaccctattgttgatatggactctagagtaggattgcgctgttatccctagggtaacttgttcc

SEQ ID NO: 350 - DNA, 341 bp, Homo sapien
ctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacacccaagatctgctcttggaatgtggatgggcttcgagcctggattaagaagaaaggattagattgggtaaaggaagaagccccagatatactgtgccttcaagagaccaaatgttcagagaacaaactaccag

SEQ ID NO: 351 - DNA, 256 bp, Homo sapien
ggcgttggggacggttgtaggacgtggctctttattcgtgagttttccatttacctccgctgaacctagagcttcagacgccctatggcgtccgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtaagatgctgcaattcgtgctgcccgtgg

SEQ ID NO: 352 - DNA, 368 bp, Homo sapien
  misc_feature (1)...(368): n = A,T,C or G
cctttcttgtaagtgaagaanaaggaatgcagcaaagaagagttcgacattggagtccttagttccatcaggatcccattcgcagcctttagcatcatgtagaagcaaactgcacctatggctgagataggtgcaatgacctacaagattttgtgttttctagctgtccaggaaaagccatcttcagtcttgctgacagtcaaagagcaagtgaaaccatttccagcctaaactacataaaagcagccgaaccaatgattaaagacctctaaggctccataatcatcattaaatatgcccaaactcattgtgactttttattttatatacaggattaaaatcaacattaaatcatcttatttacatgg

SEQ ID NO: 353 - DNA, 368 bp, Homo sapien
ctgaggggtggcagtaagcaatgaggatgggctataaagctgttaactggctaagggccatccttgggcaggcatttcagacacatctgtagagagggcagtagcatctccgataggccagctctgaaggaagcttaatgcttaatacagtcacactgcataaattagcttagaatgctctcttgggtaaaaaatattaatagtgtatatgcacttgaagagcaaaattcctcaagaaaaaaagtttaatagcaaggagtttccatcagtcccggtctttgtgaggattaccacaacaaacacttaaaaggatacaacaggtacttattaaatgctgccttgccttttacctcttccttttttttttt

SEQ ID NO: 354 - DNA, 380 bp, Homo sapien
ccatggcttctcacccagacagtctttctgggcaacttggggaagcccctgttctgctcaagtctcaccccatggaagaggtgggggaagggggccttggtttttcaggaagacaggttggagagcacgagtcactacaaagcagtaaaagtgaatggtgtctccaggggctgggtccagaacaccacggagagccccagccataaaggtgtgttccgcctctggcctgcaggaatctctttgaatctctttgattggtggctccaagagcaatgggaagtcaacagccaggaggctggactgggttccctgggaccccgaggtcccagagctgctgggcagtggttgtcggcaaagaagaaaggtccaagagggtcagg

SEQ ID NO: 355 - DNA, 347 bp, Homo sapien
ccagtggaggggtgggggtatcgatcccgccgggggctggcttggttgctggtgccctgagcccttctctgcccgcctgggtgttgccttcactgatggaggtaggcgtccagccagatgtcaccagacttcttcggggacctgacgatgtccaccagcgcggtgaggaagggcttcacttcgtagctgaggccgtgcttggcacacagcgacttgaccagcggggccacccggctgtagttgtgtctcggcatcctggggaagaggtggtgctcgatctggaagttgaggtgcccgctgaaccagttggtgaaaagtgagggctccacgttgcaggtggctgccag

SEQ ID NO: 356 - DNA, 157 bp, Homo sapien
cctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccag

SEQ ID NO: 357 - DNA, 323 bp, Homo sapien
ccatacagggctgttgcccaggccctagaggtcactcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctgg

SEQ ID NO: 358 - DNA, 555 bp, Homo sapien
aaaaggtttctaaaacatgacggaggttgagatgaagcttcttcatggagtaaaaaatgtatttaaaagaaaattgagagaaaggactacagagccccgagttaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaccac

SEQ ID NO: 359 - DNA, 549 bp, Homo sapien
ctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctcttgctgcttgagagctattgctttggt

SEQ ID NO: 360 - DNA, 289 bp, Homo sapien
tttaaattttactagtgttacttaatgtatattctaaaaagagaatgcagtaactaatgccctaaatgtttgatctctgtttgtcattactttttcaaaattatttttttctgtaaagtataatatataaaacttcttgcttaaattgaatttctatattagtggttaattgcagtttattaaagggatcattatcagtaatttcatagcaactgttctagtgttttgtgtttttaaaacagaattaggaatttgagatatctgattatatttttcatatgaatcacag

SEQ ID NO: 361 - DNA, 311 bp, Homo sapien
ctgttcagtatggcaaagggcagacttactccttcatccactctgctgccttgatgaggtgaacacactggaataagatggagggcaggatacctgccaaagcctgaggaatgagatgatctgaaacaattgggcaaaggctggacatttcaaaaagctgacttccaactgcagtttatgggtatagaatttgatgcttccctcaagtcctgactgctctttctgaggcagccaggctaggccaagaaatgagctgctccagcttctccagagcacagcagcctcccagggcctgtcagcatctgcagcag

SEQ ID NO: 362 - DNA, 496 bp, Homo sapien
  misc_feature (1)...(496): n = A,T,C or G
ccagtttctaaaanaatgcacatttaaagagaagcatctaccacggctttaaaacaaaacaactctgagatgaacaatatgtgttatactcagagattaacaatctcaatcatacatactgattctttcagacatttaataaccactacatttttttgcattaatgaagtttgactatatgtgtaaagggactaaatatttttgcaacagcctgttctttgttcattcttttctggatagcgtgtcctctgtattgcggtagatttatacattctgttgcctaaatatgtgtgtaaaatgagctgataaactggagtactacttaaaaaaaagtctgtgatttataagatgcatatgctttctatgtgaatataagcttgtgcacaatgtttaaaagaaaaacaatgaattagaagagatcccccgtcccccagtctgacatatttcatacagaatgtttaaaagaaaaactctgctagtcttggcaaacatttgg

SEQ ID NO: 363 - DNA, 673 bp, Homo sapien
  misc_feature (1)...(673): n = A,T,C or G
ccaagagggagataanacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggctttgtgcatagtgtcttcatgtcgcgtatagttgagcgcgttcttagcagttggcttcatggacagctcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgcgcaaagcttaacaatttgtaggaaactttggg

SEQ ID NO: 364 - DNA, 495 bp, Homo sapien
  misc_feature (1)...(495): n = A,T,C or G
ccaaatgtttgcncaagactagcagagtttttcttttaaacattctgtatgaaatatgtcagactgggggacgggggatctcttctaattcattgtttttcttttaaacattgtgcacaagcttatattcacatagaaagcatatacatcttataaatcacagacttttttttaagtagtactccagtttatcagctcattttacacacatatttaggcaacagaatgtataaatctaccgcaatacagaggacacactatccagaaaagaatgaacaaagaacaggctgttgcaaaaatatttagtccctttacacatatagtcaaacttcattaatgcaaaaaatgtagtggttattaaatgtctgaaagaatcagtatgtatgattgagattgttaatctctgagtataacacatattgttcatctcagagttgttttgttttaaagccgtggtagatgcttctctttaaatgtgcattttttagaaactgg

SEQ ID NO: 365 - DNA, 291 bp, Homo sapien
aactgacaagcccttgcgcctgcctctccaggatgtctacaaaattggtggtattggtactgttcctgttggcccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcag

SEQ ID NO: 366 - DNA, 277 bp, Homo sapien
ctggatggtgcctcagaaggtgcattctgcttctgcaggggcttgaaacaccaaggcactccagggatcctggagtcaaagcagcagccccggttgttgcactccttgggggtgacatgggggtagcccgcagtccaccctgtccttggctggcacggcacactggtttgcagacaggcccacgtactcctcagcagagctggaggacaagcaaggccaggaccagccccagcatgcagagcgctctggcagccatgaccaccgtgggctccgggac

SEQ ID NO: 367 - DNA, 311 bp, Homo sapien
ccagagctgcggggcctcagtacacggagctgttccggatgccacagcacagcaccatgctcaggatcatctcgaagatcatgatcacagcgaccacgatggcagcaatgccgatgaggtacagcttcccggagaagaggtcatcgatcttctggtggcagtcctccttgaagaggttgctgatgatgttgctgcccgagggacacaaattgttcttgagcactgaggtggtcaaagcagtcagtgtgctggagccacagcagtcaagcgtctcgtggaaggtcttcaccacagccttggcgttgttggcg

SEQ ID NO: 368 - DNA, 384 bp, Homo sapien
ccaaaggggtctctagctgctgctctgctgctcctgctcatggatgagtttggcgatggggccggtgatgccgcctatcaaggtccagtactcatcgaagctgatgcgcccatcaggattggcatccaggttctggatgagcttatccgcagccttccggttccctgtgtccgacagcatgtggttcagctctttctggagcatctcgcggaagctgctcttgctgatcttgttcttgaccaggctgtacctagacacatatttgtagaagttttccaccaggacaatgactgccttctccagctccgtgtagcaagtctgacatctccctgcttcgcctgctggcggggcctaaggcgggggccaagcccagttacagcccag

SEQ ID NO: 369 - DNA, 216 bp, Homo sapien
ccaagtgccaggtggctttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcag

SEQ ID NO: 370 - DNA, 561 bp, Homo sapien
ctggctccttcttttgtggtcgtttgggggatgggctggtttggggtttaggtgcagagaatggtttggggccactgcgtactggaccactctgagccttcagggcagggttcttgtgagtcttcatgtcatcagatacatgtttcagggcatgtgtaatgctctccccctgattaatctgcgcgaacagtgctgagcgggaagcagactcatctgagcctgaactggtagagactgggggaggaggggggcctggtggagggggaggaggacctgatccggcagagggtccagatggcagtccgctcagttcttttgccacaggccccgttttgctccaggccagtccggtggtatggaactccttaatgtaagcctgcagctctgtccatatacttaaataagctttgacccagtctacatgcttcttatccacatctttgtactctttgaggactcggtttgtataaaacatggcggcatcattcatttctttcgcataagggccaggcttgggagccatagccacccagcccagggcctggatactttcgctgacag

SEQ ID NO: 371 - DNA, 518 bp, Homo sapien
cccacttccatcgctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcag

SEQ ID NO: 372 - DNA, 335 bp, Homo sapien
ctggaggctgggtgcaccctgcccagatccacacctgtaccccggcggaaaggctcatgggcattgaagacggtggtgaaaaagccaaagggaaaagcaccaacaccaaatgagaagtggaagcccccggtatcaccaaatggctggaatccccctctgctctccggagctggtctctggccctgggggcggggtggagtttttaatctgggatcctggggcttctggctccctcgcccataaagcgggacaaccttctctctgctgatcccagctttacatactggacactcttgccgttctggccgtgtctccagccactgatgaagacatgg

SEQ ID NO: 373 - DNA, 467 bp, Homo sapien
ccactagctgaatcttgacatggaaggttttagctaatgccaagtggagatgcagaaaatgctaagttgacttaggggctgtgcacaggaactaaaaggcaggaaagtactaaatattgctgagagcatccaccccaggaaggactttaccttccaggagctccaaactggcaccacccccagtgctcacatggctgactttatcctccgtgttccatttggcacagcaagtggcagtgtctccaccacctatgatggtgatgcagcccctagaagtggctttcaccacctcatccatgagagctttggttccccgggcaaaagcttcccattcaaatacccccacaggaccattccacacaatctgcttagcccgagtgacagcctcagcatacttcttgctgctttcaggaccacagtccaagcccatccagccagcaggtacgccagaagccacagtggcttgg

SEQ ID NO: 374 - DNA, 284 bp, Homo sapien
tttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttgg

SEQ ID NO: 375 - DNA, 307 bp, Homo sapien
cctactcttctccgtccattgtactatctgcccgtggtggggatggcagtaggatcatatttgatgacttccgagaagcatattattggctccgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggagg

SEQ ID NO: 376 - DNA, 650 bp, Homo sapien
  misc_feature (1)...(650): n = A,T,C or G
ccattgnctnctnacgtgatgtcatcatctgccaggtcatcttggcaaaagtcggagcatttctcagtcactgcaaagtagcccttctcgttggagcaccggaagagacgtgtgtgtttcatgtactcggcatcgtcatcatagggcttctgtgccccaatgcccacccagaagaagttctcaggctcctcaccttcgttgataacctgcttgctgtaggaggtgtcaaacatggtgttcaggatgtcttctgccaacttggcttcgtcagggtctgatgcccggcccacccaggcatacacgatgccctggttgtcctcactctcaaagggaaccttgaggatgaagcagaactcggagttgaggaggctggagtcggtgttgatctggatgcaccgggtgcagagggcgctgccgttggtgcggatctggtagaggctgggctgttgggcgccctggaccgccttcctcttgccccggtggatgatgaacttcctcttgaaatgggacaggaacttggggttctcctgctgctgcgtcatgcgtaccacctccagcttcccagggaagaggctctcgaacttcttttgcaggctgaaggtgaaggtgacccacccatattgggaggctttcacggccctgccagaagt

SEQ ID NO: 377 - DNA, 306 bp, Homo sapien
  misc_feature (1)...(306): n = A,T,C or G
tctagatgcatgctcgagcggccgccagtgtgatgganatctgcagaattcgcccttcgagcggccgcccgggcaggttcgggtgctgccttcacctgccaggcccttccccgctagcttggggcgagcagagctgcgtccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcga

SEQ ID NO: 378 - DNA, 199 bp, Homo sapien
  misc_feature (1)...(199): n = A,T,C or G
ccacangtggcacttgggtgtggctcctctgttatttgtcctcatgtgagaaagcagatcatctccaaatcttgccatttgtatacttttggtggagacttggatgtcatatcttctttgttttgggttttcttccctagcttattttgtggcttttaaagaagtggattgtattgtgagatcctgtgattcctggtgg

SEQ ID NO: 379 - DNA, 216 bp, Homo sapien
  misc_feature (1)...(216): n = A,T,C or G
ccagggcangtcatcaagaggggcattgtcttgcatgcggcctgccgtgtccaccagcaccacgtcaaagccttggttacgtgcaaaagcaatggcttccatggcaatgccagcagcatccttgccatagcccttttcaaacaactgcaccatggtgcggccaccatgcttctctggagggtgtagggcactcaaacgccgggtgtgtgtacgcag

SEQ ID NO: 380 - DNA, 555 bp, Homo sapien
ccatgggccttcctttccactaaaaggaattccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcagggtcagagaagattcttcatgggaaatcaagttctaaaggctttgccccaagagatgatgaggcag

SEQ ID NO: 381 - DNA, 406 bp, Homo sapien
ctgcaccaggtgggcctctaggtcccattaagcccattggtccagggccaagtccaactccttttccatcatactgagcagcaaagttcccaccgagaccaggggggccaggaggaccaggtggaccaggagggcctgtgggaccatcttcaccatctctgcctggggggcctggtggacccctttctccacgtggtcctctatctccggctgggccctttcttacagtttcctcttgtaaagattggcatgttgctaggcataaggttactgcaagcagcaacaaagtccgcgtatccacaaagctgagcatgtctagcacttagacatgcagactccttgtgtcgcagagcccctgggtcaccggcggaggtatcacctggcgggcgcgggcatgcagtcgtgg

SEQ ID NO: 382 - DNA, 528 bp, Homo sapien
  misc_feature (1)...(528): n = A,T,C or G
ctgagcagtttgtgggtntntcttcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagaccaacagacttcagaccctcagacctgccccggggccaggtggagaaagtgagggccgtacaaggaagtgaaattctgagttgttggggctaagcctgaccccctctccatgctccccgccccaacccactctggcctcagtagatttttttttcagttgtggttgttgcccaggctggagtgcagtagcgccatcttggctcactgcacctccaccttccgggctcaagcgattctccagcctcagcctcctgagtagctaggactgcaggtgctccaccacgcccggctaatttttgtatttttagtagagatggggtttccccatgttgg

SEQ ID NO: 383 - DNA, 335 bp, Homo sapien
  misc_feature (1)...(335): n = A,T,C or G
ccatnttgagtctactcctgcgtcttgtgccctagcaccccgagaaccgtcagtttgagccagatggaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggcgaaaaaaaaaaaanaaaaaaaaaaaaaa

SEQ ID NO: 384 - DNA, 333 bp, Homo sapien
agtccaatacggctattggggttgtagcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaagg

SEQ ID NO: 385 - DNA, 343 bp, Homo sapien
ctgtgacacctcaggttgaaagggtcttcctccttgaacacccaccgaggggcctggagcaacagccagccgatatggacttctagctgcaccgggtcactgagggtggagaggtttgtctggcacctgtactctccactgtcgtcgactgtggcagcgtcaatgaagtagctcgaggcctggcttgagatgaggctctcattgtgaaaccactgtgtggaattgtcctcaggggagtaggctccctggcacttcagagtcacactgtccttctcgagcaccctgtaccattgaggctccaggaacaccacagcctttgggagatcttcagtccgcatgccaa

SEQ ID NO: 386 - DNA, 244 bp, Homo sapien
tattctttgattcttggcaaataggtgagagaactaatagcaaccaggcaactgaggacgaagtcaaaaagtcggtaacagaagaatggaatcagccaacccacttgataagaaattgctccataaaccagcattgaactgattataaacataagaacagagacggcaaaaagaacacaggcattatcagccattctctcagacgaatagtaattaccgatgacttcatactgaatgttgacag

SEQ ID NO: 387 - DNA, 504 bp, Homo sapien
atctggagtccagcctcagggatgcgctactttccattctctgcattgaacattcgttctgtcagcatccgctccagcttcactgcatcagcggcaaacttgcggatcccgtcagagagcttctccacagccatctggtcctcgttgtgcaaccaacggaaagacttctcatccaggtggattttttccaggtcactggcttgggccgccttggctgagagcacaggcaccagcttggcgttgtcctgcagcagctctcccaggagcttgggtgggatggtgaggaagtcacagccggccagtgctttgatctcgcccgtgttgcggaaggaggcgcccatgacaatggttttgtagctaaacttcttgtagtagttgtagattttagtgacactctttaccccagggtcttccaggggctcataggatttcttgtcggtgtttgccacatgccaatcaaggatgcgcccaacaaatggggagatgagggtcacacccgcctcg

SEQ ID NO: 388 - DNA, 450 bp, Homo sapien
  misc_feature (1)...(450): n = A,T,C or G
gccaaagtgctgcntgaattccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtctttttttttttaaattttntttccaggtanagtagctntttgtacataaanaatacttgaaaaattaattgtatgatgtatgaaaanacanagtctcctagttttgtatnttgttgtatgactgccatgagttccaccaaaaagccactntattttggtctntgtgacattttaaatgcgtgacaaaagtgagcaaataaagngaggaanaaatntatntatganataatatanattgtattgaaatctaaaaaaaaaaaaaaaaaaaaa

SEQ ID NO: 389 - DNA, 297 bp, Homo sapien
cctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggagg

SEQ ID NO: 390 - DNA, 223 bp, Homo sapien
ctgggctggagagttggtgctggcaaaacagtccttcccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccagg

SEQ ID NO: 391 - DNA, 365 bp, Homo sapien
ctgaggaagaaatgaaaaaagaccctgtccctcatggcccgcccactggcctcctgtgaactctgtcctgttgccaaccccagatgaagtcagccaaaaagtgctttccacatcctctctctggggctgcccagcctgaccgtaggggatccactggcagagccaaggtggatgctggtgcctgaagctggaagccagcaggacatgagacccctcctgtagcaggaagtggttctagaactcccagcagaacagaacggaaaaggagctgattggggatagaatgagttctgctaaacagccagatgctctgagagaggtgacactggactgtctcggaggtgtgtgcagatggctacaggtgg

SEQ ID NO: 392 - DNA, 302 bp, Homo sapien
  misc_feature (1)...(302): n = A,T,C or G
ccaagagctacaatgagcagcgcatcangacagaacgtgcaggtttttgagttccagttgactgcagaggacatgaaagccatagatggcctagacagaaatctccactattttaacagtgatagttttgctagccaccctaattatccatattcagatgaatattaacatggagagctttgcctgatgtctaccagaagccctgtgtgtggatggtgacgcagaggacgtctctatgccggtgactggacatatcacctctacttaaatccgtcctgtttagcgacttcagtcaactacag

SEQ ID NO: 393 - DNA, 213 bp, Homo sapien
  misc_feature (1)...(213): n = A,T,C or G
ccaataatcaagnacaaanactggatttgaggatggatcagttctgaaacagtttctttctgaaacagagaaaatgtcccctgaagacagagcaaaatgctttggaaagaatgaggccatacaggcagcccatgatgccgtggcacaggaaggccaatgtcgggtagatgacaaggtgaatttccattttattctgtttaacaacgtggatgg

SEQ ID NO: 394 - DNA, 334 bp, Homo sapien
cctacccataatccagagaggcttgcccagaggaggactacgtgggggacgtgccaccagaaccctacttgggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcag

SEQ ID NO: 395 - DNA, 174 bp, Homo sapien
ccagatgaggaaaaaaattaggaaggagatgaagttttccaaatttcatggtatatgctgcacttccccaaccttcactctccatgtagcctactgggtctactattccacaaagtggctcaacctccaaatgacctctggtttacccctattaaaatcccaaaggactttcag

SEQ ID NO: 396 - DNA, 140 bp, Homo sapien
  misc_feature (1)...(140): n = A,T,C or G
ctgcaaagccttgtgtaacnttctccagcatttggacccagtacgtgaaagcccacaacacgttcattgtctttagtattacagattatttttgcataacatttgttgttatctcttgacggaatcgtccattccaatgg

SEQ ID NO: 397 - DNA, 318 bp, Homo sapien
cctcgcctggagggcccccgggcagcacagggaggacgagcttgtccagcagagggtctggcagagggtcccgcagaggtttgggcagggggtctgacatccctggctcctgctctggctctggctgccgggatttgcacaggcccaggtgcatacagatgccgtttgagtcagtctggttctggaagtagtcgatgaccagggggaagtagtcgtcaagcacttggttgcactggggcatgagcagcttcaaggggaggacgttgcactcctgctccaggaacttcctcatcgtgtcctggaaaatggcctccttgg

SEQ ID NO: 398 - DNA, 517 bp, Homo sapien
  misc_feature (1)...(517): n = A,T,C or G
ccttncttcgccatccattcatcgaccctctccagcacttgctgcaggcttggctgaccatccaccatggcttgaataatcccggtgagctctgtacagaatggggtaagctgtggatggactacaggctggacatacatgtgaaaggtagactcaatctccatggtccggccatttagctttaggatggggaactcgatgatttcctgaggatgaatctgtggcttgtcgcacgtggcctcaaagtccagcactaaaaagtagtgatacctctggagagggaaggacaccattgccgccatggatgcgccaaagccgtgggccgccagctttctggtggatatggagcagaactccggaacaccacagggagaaaataagtgggagcccagcacttttcttgctcttgaaagtaaatacgaagaaaatcgagctgctccagtctgtaaaggtgctagcattgaacatccagaagcatctaaaactctccttacttcgaagatgccaagaccggcag

SEQ ID NO: 399 - DNA, 329 bp, Homo sapien
ccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttccttttttcggtaacaagacttagaaggagggcccaggcactttctgtttgaacccctgtcatgatcacagtgtcagagacgcg

SEQ ID NO: 400 - DNA, 451 bp, Homo sapien
ctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaagctgctggagctggcaaggtcaccaagtctgcccagaaagctcagaagctaaatgaatattatccctaatacctgccaccccactcttaatcagtggtggaagaacggctcagaactgtttgtttcaattgg

SEQ ID NO: 401 - DNA, 180 bp, Homo sapien
ccaggaagcaggccaggggattggcagcactgcccagcaccacagccaggtggtaggccagacgcccgtagggtaagcaggaaaagctctgcacggcaggcagcacgccattggtcagcgcgttggtggcggccaacaggcccagcaggcaggcactgcgggctgatagaagctgatagg

SEQ ID NO: 402 - DNA, 385 bp, Homo sapien
ccaggccacctgtgcggggctcctcgatgtggaaggttcgggtgaggagattgtagaaggagccgtagcacacggccaccacagtgcacgtgaggcagatcacgttgtagggcatgctgaagtccggtgtcggcaggttcaccagcagcggctccgtgtagagccgcacaaagtagttagagccatcagagactgggaacaggctgttgaagaggggactctcttcccagtccactggcttggctgctaccatgctgggcacaagggcgctgaggacagatgggctgacatagaagccatggttaggatctggcgtgtactcggtccacttcagcagcgcccgctcaaactggatggaaaccttggtgactgagttggccggcag

SEQ ID NO: 403 - DNA, 440 bp, Homo sapien
  misc_feature (1)...(440): n = A,T,C or G
ctgtttaaccagnaacccggggggtcaccccccacagaatgtacatgaaacactagaggactgcatgtttttccctgagagaagcgtaagacaaacagaagtcaaaaagtagtcactgggagcgccatccttctaagcaaatcctccctttcccttttggaggatttgcccgaactacgtagccagtcagcacttagaccacctgcctcctcccccccctataaacccaccactcccctcctcctttcccaaaccacttggggtgtcctaagccctcactgccccaagcccaaaatatcagctaagatccttgtcagtatttccacagtcatacctaatgaattgggaagtggggcccctaaaaaccaattcacatctatgcacttgtttccactggatttggcagacaggcttttttagttaccgtaaccagatcttaa

SEQ ID NO: 404 - DNA, 239 bp, Homo sapien
cctacgaaaaactcccggccggtgaagagaacgtcagtgccatccagcgtcgcgttctcgtctcctatttccacaattcggagccccaggtcttgcagggctttgcggactccatcgacctctggcctacgagcggggctccagggccgcgtgattagggccgtgtccccttggatcacggccgtgtcgccaagcagcggtcccagcggcaatgactcctcaggtggcagttctagcag

SEQ ID NO: 405 - DNA, 261 bp, Homo sapien
ctggagaggcagcccttcaccggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcag

SEQ ID NO: 406 - DNA, 641 bp, Homo sapien
  misc_feature (1)...(641): n = A,T,C or G
ctgctcccgggcntggtggcagcaagtagacatcgggcctgtgcagggccacccccttgggccgggagatggtctgcttcagtggcgagggcaggtctgtgtgggtcacggtgcacgtgaacctctccccggaattccagtcatcctcgcagatgctggcctcacccacggcgctgaaagtggcattggggtggctctcggagatgttggtgtgggttttcacagcttcgccattctggcgggtccaggagatggtcacgctgtcataggtggtcaggtctgtgaccaggcaggtcaacttggtggacttggtgaggaagatgctggcaaaggatggggggatggcgaagacccggatggctgtgtcttgatcggggacacacatggaggacgcattctgctggaaggtcaggcccctgtgatccacgcggcaggtgaacatgctctggctgagccagtcgctctctttgatggtcagtgtgctggtcaccttgtaggtcgtgggcccagactctttggcctcagcctgcacctggtccgtggtgacgccagaccccacctgcttcccctcgcgcagccaggacacctgaatctgccggggactgaaacccgtggcctggcagatgagcttggacttgcgg

SEQ ID NO: 407 - DNA, 173 bp, Homo sapien
ccaggtactggcacaatcatgtctggatgggggtggtggtgtcctgtaggcagagaaacaggaaattgtcgtagtcagtatcgagcagcgtggcctcgttcgccaccgtatagttgatcttgaacttctttggattctcagtcttctctccaaggaccttcttctcaacacag

SEQ ID NO: 408 - DNA, 165 bp, Homo sapien
ccactgtctgcagccatggcagaaagtgctcaaagtccagcaccttcacattcatctcatcactcttggggttccccaggaccttgagcacctcggcgttggtagggttctggcccagggccctcatcacatccccacactggctgtacaggatcttgccatcac

SEQ ID NO: 409 - DNA, 329 bp, Homo sapien
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacctatgagacacaccagtgtggccttgttggcttgaagctcctcagaggagggcgggaacagagtgaccgagggggcagccttgggctgaccaaggacggtcagcttggtccctccgccaaataccgccggataagcaccactgttgtctgctgattgacagaa

SEQ ID NO: 410 - DNA, 235 bp, Homo sapien
  misc_feature (1)...(235): n = A,T,C or G
ccatcagngagaaaggtgtttgtcagttgtttcacaaaccagattgaggaggacaaactgctctgccaatttctggatttctttattttcagcaaacactttctttaaagcttgactgtgtgggcactcatccaagtgatgaataatcatcaagggtttgttgcttgtcttggatttatatagagctttttcatatgtctgagtccagatgagttggtcaccccaacctctggag

SEQ ID NO: 411 - DNA, 294 bp, Homo sapien
aattaagggaagatgaagatgataaaacagttttggatcttgctgtggttttgtttgaaacagcaacgcttcggtcagggtatcttttaccagacactaaagcatatggagatagaatagaaagaatgcttcgcctcagtttgaacattgaccctgatgcaaaggtggaagaagagcctgaagaagaacctgaagagacagcagaagacacaacagaagacacagagcaagacgaagatgaagaaatggatgtgggaacagatgaagaagaagaaacagcaaaggaatctacag

SEQ ID NO: 412 - DNA, 433 bp, Homo sapien
  misc_feature (1)...(433): n = A,T,C or G
cctgagaagccagaggcaggtggagagggggtggaaagtgagcagcgggctgggctggagccgcacacgctctcctcccatgttaaatagcacctttagaaaaattcacaagtccccatccacaaaaaaaaaaanaanaaaaatttcagggantaaaaatanactttgaacaaaaaggaacatttgntggcctgggggggcatctnantttntntagcnccagngattccctccccnccccacccatcacatanatgtaacacctttggtntaaaatggggagccgtttccaccntgcccccntccccgcccccaggcagttgccccggngacacntcaagacaggancgaggtagtntttcancancacagttncacaaggaacagaacagtntctcccgcccagccctgcggcacaagggattgacacgcn

SEQ ID NO: 413 - DNA, 494 bp, Homo sapien
  misc_feature (1)...(494): n = A,T,C or G
ccttatttctcttgtcncttcgtacagggaggaatttgaagtagatagaaaccgacctggattactccggtctgaactcagatcacgtaggactttaatcgttgaacaaacgaacctttaatagcggctgcaccatcgggatgtcctgatccaacatcgaggtcgtaaaccctattgttgatatggactctagaataggattgcgctgttatccctagggtaacttgttccgttggtcaagttattggatcaattgagtatagtagttcgctttgactggtgaagtcttagcatgtactgctcggaggttgggttctgctccgaggtcgccccaaccgaaatttttaatgcaggtttggtagtttaggacctgtgggtttgttaggtactgtttgcattaataaattaaagctccatagggtcttctcgtcttgctgtgttatgcccgcctcttcacgggcaggtcaatttcactggttaaaagtaagagacag

SEQ ID NO: 414 - DNA, 294 bp, Homo sapien
ctgggcggatagcaccgggcatattttggaatggatgaggtctggcaccctgagcagtccagcgaggacttggtcttagttgagcaatttggctaggaggatagtatgcagcacggttctgagtctgtgggatagctgccatgaagtaacctgaaggaggtgctggctggtaggggttgattacagggttgggaacagctcgtacacctgccattctctgcatatactggttagtgaggtgagcctggcgctcttctttgcgctgagctaaagctacatacaatggccttgtgg

SEQ ID NO: 415 - DNA, 421 bp, Homo sapien
ccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacag

SEQ ID NO: 416 - DNA, 342 bp, Homo sapien
  misc_feature (1)...(342): n = A,T,C or G
ccactttctttcccacnctggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcactcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccgg

SEQ ID NO: 417 - DNA, 389 bp, Homo sapien
tattaattaggttcttaagacatttagaacaccaatttgtgaggataaattccattcgtcagagcaaacacagatcgcaggtagccctggagctgaggaatagctttgatttttggtaaaatttgtgagtccacagctttctgatcaatcttgcgctgctccgtaatctcatatttctctttttctgtgtcgaagatctcaccttcctggtgtctgggcttccgcagcttcttcttcttgaagtaagcatcagtaagatgttttgggatttttacattgctgatatcgattttggttgaagtggcaatgacaaatttctggtgtgttcttcgtagaggaactcgattgaggaccagaggtccagtcacaagtaataagccactagccag

SEQ ID NO: 418 - DNA, 343 bp, Homo sapien
gtgggagggagccaggttgggatggagggagtttacaggaagcagacagggccaacgtcgaagccgaattcctggtctggggcaccaacgtccaagggggccacatcgatgatgggcaggcgggaggtcttggtggttttgtattcaatcactgtcttgccccaggctccggtgtgactcgtgcagccatcgacagtgacgctgtaggtgaagcggctgttgccctcggcgcggatctcgatctcgttggagccctggaggagcagggccttcttgaggttgccagtctgctggtccatgtaggccacgctgtttttgcagtggtaggtgatgttctgggagg

SEQ ID NO: 419 - DNA, 255 bp, Homo sapien
cctagcaagagaatcaccaaatttatggagagttaacaggggtttaacaggaaggaagtgcctttagtaagttctcaagccagaggctggaggcagcagctaaatcagaggacagcatcctcagtgaaagtgagccattcggggtggcatgtcactccaggaataaacacaacttagaaacaaatgatttcgtaggatagcacagtgacatggtgcactgtgaacctgaggccactgtgtcaaactgtgcactgg

SEQ ID NO: 420 - DNA, 261 bp, Homo sapien
cttctgatgataaccaacccctagctaccactctgtattcatcaggggaggggtataaaccccacatgcaagaagaacccttgcccccagtgtcaaatgggatggggatgctagagttatagtaaaggggaaaccctatgtaagctgttaacagagttcacaggggtagggataacccctgttctccagctcccaaatgtgctcactttcccagcttcttcatccgttcatcaatgctggcaaagttcccctcaactgtgg

SEQ ID NO: 421 - DNA, 179 bp, Homo sapien
ccttcctgttgttgtttcaaatgctgcttgatttctcgtaacagatctgcatctatgtaatacctttcttcagatctgactgctccaaaatgattctgcatcctgatttgagacatcaattcatttagtcggcccttgaactgagtaggtgcatttagttcaccctgaatcgtatccag

SEQ ID NO: 422 - DNA, 424 bp, Homo sapien
cgaggtccaaatctgatctgcagatgcagaagattcgacagaagctgcagactaaacaggctgccatggagaggtctggaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcacaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagagg

SEQ ID NO: 423 - DNA, 256 bp, Homo sapien
ctgtggcctagggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcg

SEQ ID NO: 424 - DNA, 330 bp, Homo sapien
ccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcag

SEQ ID NO: 425 - DNA, 333 bp, Homo sapien
  misc_feature (1)...(333): n = A,T,C or G
ctgctccatggnctcaaagtcagcaccacccacacccacaatgatcactgacatgggcaggttcgaggcacgcaccacagcctcacgtgtggcttccacatccgtcacagcaccatcagtcagnagaaacagnatgaagtattgngaggcantcccctgatgtgcagcctgggctgcaaacctggacctgcccgggcggccgctcgaaagggcgaattccagcacactggcggccgttactagnggatncaganctcggtacnaagcttggcagtaatcatggtcatagctgtttcctgtgagcggntgggatgaacgcggccgtacgctcat

SEQ ID NO: 426 - DNA, 411 bp, Homo sapien
  misc_feature (1)...(411): n = A,T,C or G
gggtgttcatcatgaggattgcttctgccatggagctgatggacgtgggcaggttgctgagaaggtggggtggaagtgagtgccgggggtgggtgagtgccctggtcttgttcataggggagcctttccctagcagtggaacgctgtggtcattttctctagcatattcccttgggaagtctagatttgctattaatctggctgagaatctaagttctgtgccttagagacagtttgcactttcccatattgtgcctgggacagccatatgattttttttcccaccaaacaagtatgcaaacagaaaccagttcaaagggggatggtgtaaaagatgaggcagtanaaatgcctttgaatggttttctgtagctaattctctttaaattttgtcctgctttttttctttat

SEQ ID NO: 427 - DNA, 450 bp, Homo sapien
  misc_feature (1)...(450): n = A,T,C or G
acgtgtacaagtttgaactggatacctctgaaagaaagattgaatttgactctgcctctggcacctacactctctacttaatcattggagatgccactttgaagaacccaatcctctggaatgtggctgatgtggncatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctgg

SEQ ID NO: 428 - DNA, 377 bp, Homo sapien
  misc_feature (1)...(377): n = A,T,C or G
cagggctatagtgcgctatgttgatctggtgttcatgctaagttccgcatcaatatggtgacttcttgggagtgggggaccaccaggttgcctaaggaggggtgaacctgcctacgttggaaatagagctggncaaaactcctgtgctcatcagtagtagaattgcacctgtgaatagccnccgccctccagcatgggcaacataacaagaccctgcctcttaaagataaaaattggaaaacactngtaggaaaaaaagggtgnttggtctaaataaatntggattgggnataaatgacncaaaactatcatgaatttgaaagcntttctaatttcttgaaagtctgaaaaaagttaaancncaattttatctnaaa

SEQ ID NO: 429 - DNA, 206 bp, Homo sapien
gttgctcctccaaagaaggttggcttcaaggccgtgtccagggacccacgagcagaggcactggggggcaagggatctccaagggggcaagggatccctaaagggggtagctcacaggtgagggggtttagggcccctctagggagcgcctgaggccatacattcaagagtgtccctggtgaggcccagggaagagccaggactgg

SEQ ID NO: 430 - DNA, 473 bp, Homo sapien
  misc_feature (1)...(473): n = A,T,C or G
ccttatttntcttgtcctttcgtacagggaggaatttgaagtagatagaaaccgacctggattactccggtctgaactcagatcacgtaggactttaatcgttgaacaaacgaacctttaatagcggctgcaccatcgggatgtcctgatccaacatcgaggtcgtaaaccctattgttgatatggactctagaataggattgcgctgttatccctagggtaacttgttccgttggtcaagttattggatcaattgagtatagtagttcgctttgactggtgaagtcttagcatgtactgctcggaggttgggttctgctccgaggtcnccccanccgaaatttttaatgcaggtttggtagntnaggacctgtgggtttgttaggtactgggtgcattaataaattaaagctccatagggtcttctcgtcttgctgtgttatgcccncctcttcacgggcaggtcaatttca

SEQ ID NO: 431 - DNA, 215 bp, Homo sapien
  misc_feature (1)...(215): n = A,T,C or G
cctgtatnaagctanaaaaagactaccagcccgggatcaccttcatcgtggtgcagaagaggcaccacacccggctcttctgcactgacaagaacgagcgggttgggaaaagtggaaacattccagcaggcacgactgtggacacgaaaatcacccaccccaccgagttcgacttctacctgtgtagtcacgctggcatccaggggacaagcagg

SEQ ID NO: 432 - DNA, 391 bp, Homo sapien
  misc_feature (1)...(391): n = A,T,C or G
ccagcactgccacaaactttttcagggccaccaggcgctgcccttccaggaccgggaacctgcccacttctatccgcaggatgtagtgcagtgcagattccaggtcagccatgtagatcctggagcgatctgccaatttccaaacagtgggagctatcttgttagcagtggttggtgcaactgtggtctgggcagcctccctggtgagcccagagagtctctgcaggtaagcggtatagaaggacctggattccatgagcacggggactcgggagacggagccattccggaacagcaggtagcaagaggggaagtcggtgacaccaaactttctcaccacattggcctctgtgttcagcaccctgcgcaccgccacncctttgtgctggga

SEQ ID NO: 433 - DNA, 420 bp, Homo sapien
  misc_feature (1)...(420): n = A,T,C or G
ctgtagcttctgtgggacttccactgctcaggcgtcaggctcagatagctgctggctgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacgtaggacggttagtttggnccctccgccgaatgccgcanttctactgtcccacacctgacagtaatagtcancctcatcttcggcttgggctctgctgatggtcagggtggcccgtgntccccgagttggagccagggaatcnctcagggatcccanagggccn

SEQ ID NO: 434 - DNA, 239 bp, Homo sapien
  misc_feature (1)...(239): n = A,T,C or G
ccaaccangagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggnccccctggaccccagggtcttcctggtctggctggtncag

SEQ ID NO: 435 - DNA, 415 bp, Homo sapien
  misc_feature (1)...(415): n = A,T,C or G
ctgtccaatggcaacaggaccctcactctattcaatgtcacaagaaatgacgcaagagcctatgtatgtggaatccanaactcagtgagtgcaaaccgcagtgacccagtcaccctggatgtcctctatgggccggacacccccatcatttcccccccagactcgtcttacctttcgggagcaaacctcaacctctcctgccactcggcctctaacccatccccncantattcttggcgtatcaatgggataccgcagcaacacacacaagttctntttatcgccaaaatcacgccaaataataacgggacctatgcctgtttagggntntaacttggntactggccgcaanaattccatagtcaagagcatcacagnctctgcatntggaacttctcctggctntcagacctgn

SEQ ID NO: 436 - DNA, 152 bp, Homo sapien
ccaggattgacaggccatccattcacagccaggagatgctgggccagtccctccaagaggtctccgtcatggcagtgatgaaaacctaacagggtggccccctgtgccagctcaggtgactggagcccgagggcctgacaggttcccagcag

SEQ ID NO: 437 - DNA, 174 bp, Homo sapien
ccaggtactggcacatcatgctctggatgggggtggtggtgtcctgtaagcagagaaacaggaaattgtcgtagtcagtatcgagcagctgtggcctcgttcgccaccgtatagttgatcttgaacttctttggattctcagtcttctctccaaggaccttcttctcaacacag

SEQ ID NO: 438 - DNA, 485 bp, Homo sapien
  misc_feature (1)...(485): n = A,T,C or G
ccacggccctctcggccctctcgctgggagcggagcagcgaacagaatccatcattcaccgggctctctactatgacttgatcagcagcccagacatccatggtacctataaggagctccttgacacggtcaccgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccnggtccacaaaggaaattcccgatgagatcagcattctccttctcggngtggcgcacttcaaggggcagngggtaacaaagtttgactncagaaangacttccctcgaggatttctacttggatgaagagaggaccgtgagggtccccatgatgtcggaccc

SEQ ID NO: 439 - DNA, 317 bp, Homo sapien
  misc_feature (1)...(317): n = A,T,C or G
gggccgtcttcccctccatcgtggggcgccccaggcaccagggcagtgatggtgggcatgggtcagaaggattcctatgtgggcgacgaggcccagagcaagagaggcatcctcaccctgaagtaccccatcgagcacggcatcgncaccaactgggacgacatggagaaaatctggcaccacaccttctacaatgagctgcgtgtggctcccgaggagcaccccgtgctgctgaccgaggcccccctgaaccccaaggccaaccgcnagaagatgacccagatcatgtttgagaccttcagcaccccagccatgta

SEQ ID NO: 440 - DNA, 338 bp, Homo sapien
  misc_feature (1)...(338): n = A,T,C or G
ccanaaagacttcccagggaagatgcttggctctctgctccaaggtgggccatggtatagggccctcgaagggcttgtggctggggtgatcccagggggcattgctcaaagtgcacaggaggtggcagcagggtcaggcgagttcctgttccagggacatcaggagggagggtagaagcctagggagtgtgcgaggctgctgggatgagggagctcaggggctaccagctaaccagcctcagctcaatggtttctccatccttgggtctgtagtcagcaataccttgcaacagtggggtgttggggtctcggagaagctgccagaactccctttctcc

SEQ ID NO: 441 - DNA, 505 bp, Homo sapien
  misc_feature (1)...(505): n = A,T,C or G
ccacacagantcaccaagccacagacttgtcttccacaagcacgttcttatcttagccacgaagtgaccaagccacacgtactaaaggttgaactcaaagatatgtacagggtattaaacaaataccaaggggaacagttaacttcaatacaaggtcgaaatcagcaacaagttctacaatccagngctgatatcagatacaagcttcaaggacaatttcttttcgaaggcttattccagtttcgngaggctagcatgaggtgtgtgcatttgccaggggcaaatttctattctcaattaacccatgcagcaaatgctacncatggtgcngagtccgtttagaagcatttgcggtggacgatggaggggcccgactcgtcttactcctgcttgctaatccacnngngctggaaggnggacagtgaggccacggatggagccaccnatccacaccgagtncttgcgctctgggggtgcgatnatnttgatcttcatggtgctgggc

SEQ ID NO: 442 - DNA, 386 bp, Homo sapien
  misc_feature (1)...(386): n = A,T,C or G
cgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatctttacaagaggaaaccgtaagaaagggcccagccggagatagaggaccacgtggagaaaggggtccaccaggccccccaggcagagatggtgaagatggtcccacaggccctcctggtccacctggtcctcctggcccccctggtctcgatgggaactttgctgctcagtatgatggaaaaggagggnggacttggccctggaccaatgggcttaatgggacctanaggcccacctggtgcag

SEQ ID NO: 443 - DNA, 404 bp, Homo sapien
  misc_feature (1)...(404): n = A,T,C or G
cctccctctcagagcttgccccagggactctctggccctcagggttcaatgtattctgaccaaggccaagctttcctggggctcagggaaaatcacactttgctacccgaagctgtatcccctcagatgccaggaaggccgtgatcatctgactccaccctcctgagacacattctctccctgactgtcctgttctaagtcagcggagcaccttaggatggaggggtggaggcgaggccangatgcagcctctgtgaacaggtgcctggaggctgggaaatgaccctgagagggcaggacacagcnaccgngggcttaaggtgagggnggagagcaagnttggcccactttacaattctagntcagagccancccctaacatggngggcatttattcatttcgg

SEQ ID NO: 444 - DNA, 318 bp, Homo sapien
  misc_feature (1)...(318): n = A,T,C or G
catgggctatagtgcgctatgttgatctggtgttcatgctaagttccgcatcaatatngcgacttcttnggagtgggggaccaccangttgcctaaggaggggtgaacctgcctacgttggaaatagagctggtcaaaactcctgtgctcatcagtagtagaattgcacctgtgaatagccaccgccctccagcntgggcaacatagcaagaccctgcctcttaagataaaaattggaaaacactggtangaaaaaaaggctgtttggtctaaanaagtctggatngggtataaatgacacnaanctatcatgactnt

SEQ ID NO: 445 - DNA, 418 bp, Homo sapien
  misc_feature (1)...(418): n = A,T,C or G
ccagtccaacctgctcctcattattgtataaatgagcagaatcaatatggcggaagccagcttcaattgccaatttggtggcctctaaagctttacttttaggaacctctgcaggcgcataggtgccaaatcccaggacaggcatgaagtgaccatcattcagcttcacacactgatatttcgaatccatttctgtcactagcctggctggcaaatgtttctttcttcctccctcacaggctataagagcaatgagctggcaacgcccctgagcacactgtctgctgnttaaccaatggcatgtgagaggagggacagaggcagtcttacacaagctgtgataaaaattgcatncagttcaaccagtttcttacnttattctaatgngnaggaagtgtgngaagagcacaaagtcaga

SEQ ID NO: 446 - DNA, 361 bp, Homo sapien
  misc_feature (1)...(361): n = A,T,C or G
ctgtccaatnacaacaggaccctcactctactcagtgtcacaaggaatgatgtaggaccctatgagtgtggaatccanaacgaattaantgttgaccacagcgacccagtcatcctgaatgtcctctatggcccagacgaccccaccntttccccctcatacacctattaccgtccaggggtgaacctcagcntctcctgncatgcagcctctaacccacctgcacagtatccttggctgattgatgggaacntccagnaacacnacacaagagctctttatctccancntnactganaagaacagcgcgactctatnccttccagggggggggggtggggnntgnggaccttnccgggcc

SEQ ID NO: 447 - DNA, 321 bp, Homo sapien
  misc_feature (1)...(321): n = A,T,C or G
ccagganantggttccccaaaggggacctcacccgccccgagctctggagccgctgacgctcgcatccaggacatttgagatgggaatccaaataggctacttgnaaaagacgtgctgcangcagccctggagagactcatggagttcattgtacattactccatctaccgaggcagcgcatggcatgactnaacggcttgnaacaaacacanaaattaccaccacaaacattcaggaaccaaatataatctgctatggtcacaccacagacaatgcaggaagaggctttttattgctngngtgngttttcaaatcatgtt

SEQ ID NO: 448 - DNA, 325 bp, Homo sapien
  misc_feature (1)...(325): n = A,T,C or G
ccagcttcaactttttagtatagaagatacaggatcacaaaaaggagactacgctttgcaaacatagcatcaaaattcaacttttctctttgcagtttatccatggngtcagcataccttgcaagggaagctacttacatcaaataacttttctatatacatttcctcattgaccttttctcaaagaatatcttggttttgccgaacaaacataatataggngtctgccagatccattcctggtttctgtngtgaaggaaaagcagggggaacaaaataatatcagggtctcaatngtganattattatttaatcataccctgan

SEQ ID NO: 449 - DNA, 123 bp, Homo sapien
  misc_feature (1)...(123): n = A,T,C or G
cattaatnttggaagcgatggtgtggattacatcagtgttagggcatggtgtggatattattacattannattggaagcgatggtgtggattacatcagtgatagggcacggtgtggatatta

SEQ ID NO: 450 - DNA, 328 bp, Homo sapien
  misc_feature (1)...(328): n = A,T,C or G
ctggcaattttgagctgccggttatacaccaaaatgttctgttcagtacctagctctgctcttttatattgctttaaatttttaaagaaattatattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatngggatgtttttgtaangttaattttctaagactttttcacatccaaagtgatgctttgctttgggttttaactgtttcaacntnggn

SEQ ID NO: 451 - DNA, 209 bp, Homo sapien
ctgccttgtttcaacagacatgcaaagatcctaggagacagtccccatagaccttcagacattaaaaagggagccgtacagtttgtttgaagcacttcgtcttacccatttatgcaggggccccaggaaacttacacacagccagaatgaggttcccaaaggacttacattaattatggctcttgcttcctttcacaaatgagctgagg

SEQ ID NO: 452 - DNA, 457 bp, Homo sapien
  misc_feature (1)...(457): n = A,T,C or G
ctgtctantcccttcaagagctgtttatagaagcttgagaatggggtaaaaatttctgctagcaaaatcaagttctttttgaaattttatcagtaatccagaatttagtagtccatgccttctcactcagcatttagaaataaaaatgtggtttcttaaacgtatatcctttcatgtatatttccacatttttgtgcttggatataagatgtatttcttgtagtgaagttgttttgtaatctactttgtatacattctaattatattatttttctatgtattttaaatgnatatggctgtttaatctttgaagcattttgggcttaagattgccagcaccacacatcagatgcagtcattgttgctatcagtgtggaatctgatagagtctngactccggccacttggagttgtgnactccaaagctaaggacagtgatgaggaagatggcatgtgg

SEQ ID NO: 453 - DNA, 277 bp, Homo sapien
ccaattgatttgatggtaagggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactacgagggcgtgatcatgaaaggtgataagctcttctatgataggggaagtagcgtcttgta

SEQ ID NO: 454 - DNA, 198 bp, Homo sapien
gttaaaagatagtagggggatgatgctaataatcaggctgtgggtggttgtgttgattcaaattatgtgttttttggagagtcatgtcagtggtagtaatataattgttgggacgattagttttagcattggagtaggtttaggttatgtacgtagtctaggccatatgtgttggagattgagactagtagggctagg

SEQ ID NO: 455 - DNA, 608 bp, Homo sapien
  misc_feature (1)...(608): n = A,T,C or G
ctgagcaagctaaggaccaggggcaactagaccctaataatgngtacttttgaaaatgatacaaactaccttggttgtaagaagtgcaggttgaacactttaggagaacagtcttcaaactggcaattcaaaatttcccattatatgtgaataaaattggaaggatgttaaatgtccatggaaagttactcttgtaagttaggatgccttatactgaggctttanaatgaaagtacacttcacaaatggaatagtgaacataaattaccagaagtcaagataatagtcatactagtaaggtaagcaaggtaaattcccttatacacaaaaattattttgatgacctttttcaataatgaatctgaaatgaagtgttttaaaaagctccctaaacacaaaacgaacataaaactgcttaataactttagagctcatgtaatattcttgctgaaaacagttactgaaattaccagcgaaatgatggaatatctttaaagcaggncactcngtataatctggaataatttcatttgctaacttttaagaagtattctctggactataaatcntgggcaaatagacttccactttattattaccccaaatta

SEQ ID NO: 456 - DNA, 467 bp, Homo sapien
  misc_feature (1)...(467): n = A,T,C or G
cctggacctgtgtaaaccttcaaacactcttttttacattaggtcgtgaagttaaattttttactgtttctgtgctacagactcttcaaagggaaatagttaagtcaatttcaaagaaaatgaccagcacatttttaaaacattagaaatgatttgactttgactatctactgccaaaaaaaggttaaggaatttgtaatgagaagctaaaaactttaaggaattttaaggaactcaaaacaaaaactcattaaatgtaattaaagtgaattctacaaataaagcctcttaatacatttctataatagtcacttaagacttaaattcaaacactagcaaaccacaaaatcagactgtntgactgacatccaaaagataaatataaatcaaaatccgaccccagcattagccaaggggtaggtgttcctcttgaggaaggcaggaattcctcttctgccacctgttgg

SEQ ID NO: 457 - DNA, 183 bp, Homo sapien
  misc_feature (1)...(183): n = A,T,C or G
ccaaattttntactttaaacactgaaaacagaggaagttaataaaaattttaacctataaagtcccctggttgttagtcattaacagcagattgtcagataagactggtaaaatgatggctgctaagcatttgatgatccaggcgcaggatgatcaaactgcagcagatcatgcacgtgacag

SEQ ID NO: 458 - DNA, 445 bp, Homo sapien
  misc_feature (1)...(445): n = A,T,C or G
gaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggtttttggaagagttagaagaatttggaaggccttaaatatagtagcttagtttgaaaaatgngaaggactttcgtaacggaagtaattcaagatcaagagtaattaccancttaatgtttttggcnttggactntgagttaagattattttttaaatcctgaggactancattaatgggacag

SEQ ID NO: 459 - DNA, 426 bp, Homo sapien
  misc_feature (1)...(426): n = A,T,C or G
cctatgatancttctctagctatcatactccaatcagcaaaaaatgagaaaatgttgagaaatagaagataattcctcatttaaggccaccttctagaatttgtgcttaagattctgctttcttctcatgggccagcacttcggcaactggcaaaaattaggtgtacagggatctaggtaatactgtttatttgagcaataatatattgtgctaacgttcaggcatcctattactgagaaataagggaaaatgagtgtaaagtacaactaagagtctcggcgacagggaaaaataccatcagttaaatatccatagtcctagagcatttatgtaaaactgcaatntgaatcctgcaatacatnttggctttttccctcagtgataccatgtgagggaagnngctctgtcaaggcgggccggataga

SEQ ID NO: 460 - DNA, 348 bp, Homo sapien
  misc_feature (1)...(348): n = A,T,C or G
ccaaattttaaaatgttatttttcatatcatttataaccttgtcacaatccacttaaagaagtttggttatatttcactgaaaattttcttccagagtaggttttttttcgtgggttggggggtaactttactacaattagtaagtntggtgcagaatttcatgcaaatgaggagtgcagcagngtgataatttaaacatatntaaacaaaaacaaaaaaaatgaatgcacaaacttgctgctgcttagatcactgcagcttctaggacccggtttcttttactgatntaaaancaaaacaaaaaaantaannacnttgtgcctgaaatgaancttgtttttttntna

SEQ ID NO: 461 - DNA, 378 bp, Homo sapien
  misc_feature (1)...(378): n = A,T,C or G
ccactaagacagaacggaatctagtagaagtgcaccaatgcttcagtccctcctactcagcatggtgagcagtggtcaatctgtgccctgtggaatgatgggcagataattctggcatgtgtaaataataataaataattcacttggtgcaggcagtatgtctatgaattaaaacctagtgtgtacacagtgcctacatgtgttacagccccacagtaggaatctacaccaaaatatttattagaaggaatttggtccgtactacatcacgctttccggagggtaaaaaataaagtccatctatagacatttcaccacagacccagagactgagtctggctaaaacctgcaaaatgtctataacaaaagnggatggct

SEQ ID NO: 462 - DNA, 197 bp, Homo sapien
  misc_feature (1)...(197): n = A,T,C or G
gcgaggtccacactattaaaagctgttgggtaattgaaggtgatataaaatgactgtcntcatttggagtgngcagcacanttacttcatgttgctcangtttanaacaatntcccctgnaagttctcacacagatnggnagaaatcatacctanttntggtnaatcactatggcagccgtngaagaatntaagaga

SEQ ID NO: 463 - DNA, 279 bp, Homo sapien
  misc_feature (1)...(279): n = A,T,C or G
cataagtgatgangaggnaaaatcantnaataagcctacaacntagaatacattaaaacttgcacatatacatgttcacagcatgtatacaatgataatccctacggtttaaccaagttatggttcccttctacagcagacacaaaaccaaggtgaactaggtnggcagatgtanagggaataccaaaaaaagggtaatnngntcactgattctgaagnatntgactgancatactgagcttctgnactttgggaatgcatnnaggnaacaatatcttg

SEQ ID NO: 464 - DNA, 552 bp, Homo sapien
  misc_feature (1)...(552): n = A,T,C or G
gatgggttgataggtgcagcaaaccaccctggcgcatgtttaccaatgtaacaaacctgcacatcctgcacaggtactccaaaactaaaagtaaaaaaatctaaaagaaaaaagaaaaagaattaaacccaaaatcacttccccatctggacttgatttagatgaaaagcttctggactttgagctgatgctatagtgggttgaaaattttggggtcctcagaaggggatgaggatatattgcatgagagagcaacatgaatcatngagagccagagtatagagagnggtgggtagactgtaggagagccctcaatgatcccggctgtcttgtattcgcgttgcacttacttgtataatatggcagatgggatgtgatgtcactttcaagattangttataaatagactatggcttcaatcagagggttttcttctctgtctanctctcttttgggtagnttcattctgagagaaagccanacctcngccgcnacccacgctaaggggcganttccagcncactggcggccngttactagtggatccgngct

SEQ ID NO: 465 - DNA, 444 bp, Homo sapien
  misc_feature (1)...(444): n = A,T,C or G
ccactcttggtagaaaccttgaaactttcaccttgctgggctttagcaaagtttccttttacagttctgtttatgagcttcagctactgataaagcacttcctgaacttctctattatcatagngaccctctgaataacctgagtgactggctcggcaattcgctttataaccattcttattcccaaagttggagcacataaacatttagatgtcttttcctgtaaaatattctagacatttacccaaactctagttcaacatatactcaacttgcactgtatatctccctgcttttttgagacagagaagaaattcaggaggtgncccatctccagagtttctctgttggaaagcagcnatcaagaancctttaaaaaattggtgtnaagctntgccncctgcagaaatgcntngccccacattattcttctggggnaaagna

SEQ ID NO: 466 - DNA, 381 bp, Homo sapien
  misc_feature (1)...(381): n = A,T,C or G
cctactatgggtgttaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggnttcgggggtcttagctttggctctccttgcaaagttatttctagttaattcattatgcannaggtataggggntagtccttgctatattatgcttggttataatttttcatctttc

SEQ ID NO: 467 - DNA, 95 bp, Homo sapien
  misc_feature (1)...(95): n = A,T,C or G
cctatanattntggnttgtatactgggtcctgaaaaccctcttggngctctgtttttaaggagctgaanccaangancgccaataataatacttt

SEQ ID NO: 468 - DNA, 224 bp, Homo sapien
cagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccagg

SEQ ID NO: 469 - DNA, 416 bp, Homo sapien
ctgagttctagttcaaaagctttatccttaacttcgtcatgtactatgtaaattctagaatagaaaagggaaaggtaagattttggtaacctccaaacattgaagtagttcacagacccaaagtcagtacaaattagaatgtccatccataataaaagtatctataaaattacacagacacattctacatagtatttaacattagagaagacaaattacacagggactgaaataaaatgaaacatctactctcccgacaaatgttgaatatacctaatcaacccaagttcagtttatttttgcacattgctttagagatataacttggctgggcacagtggctcacacctgtaatcccaacactttgggagaccaaggcggatggatcacttgaggtcagttcgagactagcctgg

SEQ ID NO: 470 - DNA, 376 bp, Homo sapien
caccttttaactgtatcacaaagtctgttgctgtggttacagcctttgtttccagtgatgttttgtccatgctttcccccaacccttaacaatggttactcaaaagaatgaaataatgagtcattcattcgggaatatgttaaaatatccctctttatcattacatttcactgcttagaaactaggctgtaattcaaggcaacagttaagtctgagaactgttaaaaaaatctttgattttttttcatttttaagaaaaacctgcctatttaattgttcagacttgtaagaggttcttcaattacatcctttttggttaatgtattatttctggaacaagtagataaaattctacgcagtaagcataataaaaatc

SEQ ID NO: 471 - DNA, 357 bp, Homo sapien
ggcttcgtataatggttcttttgtcacccctgatcgacgatttcgctacccgtacaactctgacaagggaacgaaatgcttctgtgtattcacctagtggtcctgtgaacagaagaacaacaactccaccggatagtggagtactgtttgaagggttaggcatttcaacaagacctagagatgttgaaattcctcagtttatgagacagattgcagtaaggaggccaactacggcagatgaaagatctttgcggaaaattcaagaacaagatattattaattttagacgaactctttaccgtgctggtgctcgagttagaaatattgaagatggtggccgctacagggatatttcag

SEQ ID NO: 472 - DNA, 557 bp, Homo sapien
  misc_feature (1)...(557): n = A,T,C or G
cngagatgacatttacaatctcttgaaangcagcagatggcactctggtgcttcctatgaagcaacatgcttgaaatcaagggccaacaattgttgtaggaaagcaaaatatacctctaacacctacgtttaccaaaaaagctgacatctcaaactctgagttgttgagactcaaatttctcatccccaaagaagcctattacggtagtgtgntggatgctttttgtatctctgataggcaggcactataatggggggaaatacttctgaataaaaacattggctgtcttgcaactgtgcatataatgtctattcaagggggcagtgtgcctagcatgatcctgaaatgttgagataaaaggaagttggcattaaagcactatttgtcttatatgaaaagagtgactctatcttccagtaaacaaganttcctgcaatgaaaaagaaattttttccttcattatctataaactatacaaaataaccttcctttttaacctaagactcaaacattnatatttgattttattctatttgataccaattggtatgtccag

SEQ ID NO: 473 - DNA, 264 bp, Homo sapien
cctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcag

SEQ ID NO: 474 - DNA, 165 bp, Homo sapien
aattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccag

SEQ ID NO: 475 - DNA, 417 bp, Homo sapien
  misc_feature (1)...(417): n = A,T,C or G
aagttctcttcttgttttaaacacattcctgataacttctaaagatgaccaaaataaaacagaatatctacagagatcattttctgaattttttgtacatccaaggataacaacataaaaaaaataaaactggacagcattccacatccaagtgcacagaaccatttttgcaagattaaataatgtaaacattgggaacagccaaatcagcgaagaatgccaacacctcaaaacacctggtgttgccgcttcattaagtggttcaaaatccagatctataattgcgcaatattcaccgtatataaaaagaaatggatattaattttgacaaatagctgcaactgagacttctttttatttctttatatgngnatatagtgaatttttattatttttaaaattttatttattttttta

SEQ ID NO: 476 - DNA, 321 bp, Homo sapien
  misc_feature (1)...(321): n = A,T,C or G
catttaataacaaaaacaacctgtacggaaaacccnaaggcaaccacatagcatatgtaaaatgtgcaaatacactttaaaatgcangttattctatagcanttgcaagatagaatttcactgtaattagggaatctagctcatcctaacttaatagncttttgcatgtntagacaatgcaattctacaaggnacnactcagcgttgatgctaaagtatgaaacacatcctcagattattcatccgaaaatattaaaatagcntcatgttttattattctttaatgagtcntgagctcatttctaaagcttcataaagcat

SEQ ID NO: 477 - DNA, 546 bp, Homo sapien
  misc_feature (1)...(546): n = A,T,C or G
gctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctgcacggtacatgagtttcttgcaatgacaaatgaacagaaaacagcattaaagtggcaattcctcttggaaagaagcaaaatttatttaaaattcgttctatcacacagagcaaggagtggattgaaaattagtgtactctcgtgcaagcttgcagatcctactgaggcaagcagaaacttgtctggacaaagacatgtttaaaacggtctatcattttgaactctggaaaagtataagagttttaactccctttaaaatggaatattaatttgaaaattatggggaaaattgcattttgtttacatgtggtgaacatgtttctagaaattggtatggcgggaagggggctgggtgagtctgaaggacctcn

SEQ ID NO: 478 - DNA, 100 bp, Homo sapien
aagaaaagtggtaaaatcaagtcttcttacaagagggagtgtataaaccttggttgtgatgttgactttgattttgctggacctgcaatccatggttcag

SEQ ID NO: 479 - DNA, 508 bp, Homo sapien
  misc_feature (1)...(508): n = A,T,C or G
gnnttccaaattcttctaactcttccaaaagccttctgccttagttttttttaaattacaccagtccttttagtagctttttgatgtgatttttaaccaacttccccttctagcttcaagtattcttctaaattggtcctggtctacgtaaacaccctcatcttctcaagctttaccttctaacttctgcaccaccagaaattaaattgatgggcttttaaaataaattggttaccaataatttcctcattttttcagtgctattttatccaatttttggctttatatttttctatcttctatacttctccaatacttgtcttagcttgtttttcattttctatctgaaactcttgacaatatcttctaatttccctatcttctctattcttttcttcgccttcccgtacttctgcttccagntttccacttcaaacttctatcttctccaaattgttcatcctaccactcccaataatctttccattttcgtgtagcacctggncag

SEQ ID NO: 480 - DNA, 81 bp, Homo sapien
ggtgcccttttcctaacactcacaacaaaactaactaatactaacatctcagacgctcaggaaatagataaggaaaatgac

SEQ ID NO: 481 - DNA, 306 bp, Homo sapien
  misc_feature (1)...(306): n = A,T,C or G
tcgccttcggccgccgggcaggttaggggnacaagacgctacttcccctatcatagaagagcttatcacctttcatgatcacgccctcatagtcattttccttatctgcttcctagtcctgtatgcccttttcctaacactcacaacaaaactaactaatactaacatctcagacgctcagggaatagaaaccgtctgaactatcctgcccgccatcatcctagtcctcatcgccctcccatccctacgcatcctttacataacagacgaggtcaacgatccctcccttaccatcaaatcaattgg

SEQ ID NO: 482 - DNA, 582 bp, Homo sapien
  misc_feature (1)...(582): n = A,T,C or G
ggggggaacagtcattatacattatttagactcattccttcttccagtgcccttatgattatttcctacctttaccattgatcttaaactgngcaggctaaaaagaggaaccagaactcccttaagcacttttaagactatttaaaaaataaagntttgttggcattgaagagtaagctgcttaagggactgaatgaaaagatagtaccctttgtggctgtatgaagagagaaactgaatttctatccaagagaccttaatntagcctattagggaattatcttccccaaaagtacaagtaattttgcactgcaggagaaggataagtagatttgatttacatcacattttatacacacctttcaaganggagaaatctgcttcataaatagnaggaatctatgcttaaactnaacatttaatggtgacntcttacaacagccttgaaaannattggaantcngacntganggnggaaactggaanaaagaatatctttctcttctgcatcctttnatcctcaaacttagcatggattcacacgctgaggaaangttnggtnacnaccngaacatttagata

SEQ ID NO: 483 - DNA, 275 bp, Homo sapien
  misc_feature (1)...(275): n = A,T,C or G
gcctcactaaaataacagatttcagtatagccaagttcatcagaaagacccaaatggaatgatttacaaaatagaacactttaaaccaggtcagtcctatctttttgtagctgaaggctatcagtcataacacaatttcgcgtacacctctgctcattatggaattacacttaaaacgaatctcaagagggtgaccattgttgtttcagataccatccctaaggagagtggttaacaggaagattgccagngttactgatggaaagaagcgcttg

SEQ ID NO: 484 - DNA, 434 bp, Homo sapien
catatttccacaggccaatttctttctgtttttctgctaagctatttcagcattttagcttttcctctttgctttgtttactcatgattgccagatggctacgttacctctaagcatcagatcctcacaaattaatggttaaatgtaagggagggattttactctcttgcattaaaaaaaagctttattgagatataatttactgtaacattgactcatttaaagtatgctagtcaatagaccaaatcttgaataaactcccattcacaattgctacaaagggaataaaatagctgggaatatagctaacaagggaagtgaagggcctcttcaaggagaactacaaaccactgctcaagaaataagagaggatacaaacaaatggaaaaacattccatgctcatgaataggaagaatcaatatcgtgaaaatgg

SEQ ID NO: 485 - DNA, 291 bp, Homo sapien
  misc_feature (1)...(291): n = A,T,C or G
ncaccactgcagccctacatacagttgaaaaaaaattccattctgttaacatttgttttataagttttcacgcaatacacaaaaaacccctctgcacttcttgtaaagaacaaaaaagatacacaacagttaagcgtaaagatcacaggcaatagcattcaaacatggatgtgggtagagaaaggagtacctggcatgagtacctgcttagtttgactgaatccttgatttttaatttggcttttcatgggccgctcacaacaccaacgctgtgtgaggtatggtagtcag

SEQ ID NO: 486 - DNA, 274 bp, Homo sapien
ctgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgattgttctgtaactagttgctctcattttaatttcactgg

SEQ ID NO: 487 - DNA, 184 bp, Homo sapien
  misc_feature (1)...(184): n = A,T,C or G
tggcaccaagattctcagctcacggtaccagcatctgattgtcggactacctgctgctttccctgatatttatacatgatattcgnaaaatgtaaagaagctattattcatacagacatctagagaaggagngaagnttttaaaaaaataaaaaaatacttatttcaagctttagctgtgttct

SEQ ID NO: 488 - DNA, 393 bp, Homo sapien
ctgcatttttattgcgatctgcagatgaactggaaaatctcattttacaacagaactgggacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccag

SEQ ID NO: 489 - DNA, 607 bp, Homo sapien
  misc_feature (1)...(607): n = A,T,C or G
gtgcttatgtacttaaggggaactactctaactgggtgaagagtangatgaagcatccatgtccctacaaaggatatgaactcatccttttttatggctgcatagtattccatggtgtatatatgccacattttcttaatccagtctatcatcgatggatatttgggttggttccaagtctttgctattgtgaatagtgtcgcaatgaacatacatgtgcatgtgtctttatagcagcatgatttataatcctttgggtatatacccagnaatgggatagctgggtcaaatggtatttctagttctagatccttgtggaattgccacactgtcttccacaatggttgaactagtttacagtcccaccaacagtgtaaaagtggtcctatttctccacatcatctccagcacctgttggttcctgactttttaatgattgncattccaactggtgtgagatggtatatcaccgtgggtttgatttgcatttccctgatggccagtgatgatgaacnttttttcatgtggtttttggctgcataaatggcctgccttttntacttctataaaatttttcanntcttattattattcctgggggnttaag

SEQ ID NO: 490 - DNA, 179 bp, Homo sapien
  misc_feature (1)...(179): n = A,T,C or G
cttctaggaatactagtatatcgctcacacctcatatcctccctactatgcctagaaggaataatactatcactgntcattatagctactcccataaccctnaacacccactccctcttagccaatattgngcctattgccatactagtctttgccgcctgcgaagcancggtaggacc

SEQ ID NO: 491 - DNA, 399 bp, Homo sapien
  misc_feature (1)...(399): n = A,T,C or G
cctctacctgtaatcacattaatttttctaaagacaggggnggtgttttgaagataaatgtcattagtctatgataatagcatcataggacaattagccattttagacttgaccatattttctctttttagcatatagccatcttgatatttaggngggagactactccaatggagcaacagtttcattttacatgattggatttagaaatttacaaattttaaactcataagaattctaaataatttgaaaatggaaacatttgacccacagtctagcagcataaatacatttataaaatacttcattgttgatcttaggtcattgatttaaaacagaatttggtgactatgggcaggtggagggggccngtgaggaaggtataaaagagaaatcttt

SEQ ID NO: 492 - DNA, 482 bp, Homo sapien
  misc_feature (1)...(482): n = A,T,C or G
ctccaccttactaccagacagccttagccaaaccatttncccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggggagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtagg

SEQ ID NO: 493 - DNA, 207 bp, Homo sapien
  misc_feature (1)...(207): n = A,T,C or G
cataaatattatactagcatttaccatctcacttngnggaatgctagtatatcgctcacacctcatatcctccctactatgcctagaaggaataatactatcactgttcattatagctactctcataaccctcaacacccactccctcttagccaatattgtgcctattgccatactagtctttgccgcctgcgaagcagcggtagg

SEQ ID NO: 494 - DNA, 283 bp, Homo sapien
  misc_feature (1)...(283): n = A,T,C or G
ccaattgatttgatggtaagggagggatcgttgacctngtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcgtcttgtagaccta

SEQ ID NO: 495 - DNA, 590 bp, Homo sapien
  misc_feature (1)...(590): n = A,T,C or G
tatgtatataattttcttagttactagcatagagaaattactgatttaaaaaaacatttcaaattctagcatgttgtaggattctattgccctttctaaaaagtacatcttgcttatccgatttctaacaaaactatttaatttgaagaagggagaatgaatttggataaaaagcaaaaatttaaaggtactcaaatttaggcaaaccattaaagcaatcttagtttacagttaattgggtagaatggtcaacactttcttcaggttagttcatggagtggatatgcattgatagaacaacttagagatgcttttacagttgagaaagctcattatatttgttatctttaagaatcagcttatttatttcatatgtttgttctttaagaagaccaaagagccctgcaaatgaatgttgatttgtttttttgtttgtttaatatttttgtagagataagatctcactttgttatgttgcccaggctggtctcaaactctcaacttgaagtgatctgcccacctcagcctcccaaagtggtgggattacaggcatgagccaccgcacctggacctgcccgggcggncgctcg

SEQ ID NO: 496 - DNA, 307 bp, Homo sapien
  misc_feature (1)...(307): n = A,T,C or G
ggagattagtatagagaggnanacnttttttcgngatatttggtcacatggataagtggcgctggcttgccatgattgtgaggggtaggagccaggtagttagtattaggaggggggnngttagggggtctgaggagaaggttggggaacagctnaataggttgttngntgatttggntaaaaaacantagggggatgatnctaataattantgctgtgggtggttgtgntgattcaaattatgngctttttcggaganncatgtcangtggtagtaaatataattgttgggaccattanttcttan

SEQ ID NO: 497 - DNA, 216 bp, Homo sapien
  misc_feature (1)...(216): n = A,T,C or G
cattttcctcttggtttcttcagttaagtcaaanngncacgttcctctttccccatatattcatatatttttgctcgttagtgtatttcttgagctgttttcatgttgtttatttcctgtctgngaaatggtgtttttttttgttgttgntggtttttttttttttttttaaactnggnaccncnaanttgaaaaaatgnttntttttccctnaca

SEQ ID NO: 498 - DNA, 375 bp, Homo sapien
  misc_feature (1)...(375): n = A,T,C or G
gaatttcctggcaccttttctcgctagagaagattnngtgtgactgggttgcctataagccatatagatacaaacttttatctctaataccaagtcttagagggatatattaatagatctaataaatttattcttagacttattgtttcatgggntagtgagtctttgctactggagacaatacagacttgtcagtttttttaaaaaaaaaaaatttgccaagctancacattaaaaanatntcctaaggctntcattttatgaggatgattataaacntttntgngataaatatcaccataataaactgttaagtacaactgcnggccncccttanagngaattcctncagttanaaatttatttttttgccaa

SEQ ID NO: 499 - DNA, 215 bp, Homo sapien
  misc_feature (1)...(215): n = A,T,C or G
ccacnaaagcagaagcttaaagcatagtagtaaagaggnnaaaaagaaggacgaaaataaatcagatgacaaggatggtaaagaagttgacagtagtcatgaaaaggccagaggtaatagttcactcatggaaaagaaattaagtagaaggttgtgcgaaaatcggagaggaagcttgtcacaaaaaaaaaaaaaaaaaaaaaaaaaaatgtttt

SEQ ID NO: 500 - DNA, 489 bp, Homo sapien
  misc_feature (1)...(489): n = A,T,C or G
ccactacgataagcaggtagctgggttttgtagtgagnttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggnttgtctactttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgctta

SEQ ID NO: 501 - DNA, 286 bp, Homo sapien
aaaaacactcaaacacagccttggagggaggagtcagttttaaaagactcttataaaagtaatatactgctagctctgaagaatcggaggctaaaatcatctcttcaagtccccagggaatcccaaagaactccaggggaaggtgggatgggccagagagctctggaagcttccaggtctgttgcaagcctcacctggtacacagtaggctcttccaggtctgtcaggaacccaggagcctcccctagcacacagtaggctcacaaaaagggagcactgctgctgg

SEQ ID NO: 502 - DNA, 168 bp, Homo sapien
  misc_feature (1)...(168): n = A,T,C or G
cctatgattgtgggggcaatgaatgaagcgaacagagnttcgttcattttggttctcagagtttgttataattttttatttttatgggctttggtgagggaggtaagtggtagtttgtgtttaatatttttagttgggtgatgaggaatagtgtaaggagtatggggg

SEQ ID NO: 503 - DNA, 173 bp, Homo sapien
  misc_feature (1)...(173): n = A,T,C or G
cctttataataaattaggcaaaaggttcagtgcnnggctatantggacaacatgaaactccataaaaatgactggatagggggactgcttgagacttttcttttgggcattactaacagaattcaaagaaattccaaccacgcttatttttccaaattctactgaaatgagag

SEQ ID NO: 504 - DNA, 310 bp, Homo sapien
  misc_feature (1)...(310): n = A,T,C or G
tagtattctatttaaaaattaagttttggggtctgtaaaatatacaggacaatgacttttttaaaatgtaagttaatacctcctcctcacttgtcttaattgaacttaggtgtttattcttaaaggnggaccttgatgaaaatgttgagatgggaagtgttattaggcaaaacttgttatagatttctcatataactcttaattgacccttagaattttaacaaccgcgcctggcccaatagactgttttttagagtanttttaggctctcancaaaattgaggggaaaatacagggtgttcccattaaa

SEQ ID NO: 505 - DNA, 530 bp, Homo sapien
  misc_feature (1)...(530): n = A,T,C or G
cctcagggaacttacaattatggcaaaaggggaaggggaagcaagcaccttcttcacaaggcatcaggagagagagagaaagagagtaggggaaactaccccttttaaaccatcatatcctgtgagaactccctcagtattagaagagcatgagggaaaccgcctccataatccaatcacctcccaccaggaccatccctcaatacatgggggttacaattcaagatgaggttcgggtggggatacagatttaaaccatatcagaatggttaatgatattgttgtattttaccaactataatcttcttagtgttatagtacaataatgtaaaaaattgagtaaatttgttttctatattattctgtttttggaaaacatgtatatagtcagggctgtttgtctcaagaaaatatggtaaactctgctgttttggtcactggtgcctagaatttggggatgtacattggttttgattcacatgcacatttccttctagttcacagtaactatttctaactatttcccnata

SEQ ID NO: 506 - DNA, 352 bp, Homo sapien
  misc_feature (1)...(352): n = A,T,C or G
cttgaacgctttcttaattggtggctgcttttaggcggtactatgggtgntaaattttttactctctctacaaggttttttcctagtgtccaaagagctgttcctctttggactaacagttaaatttacaaggggatttagagggttctgtgggcaaatttaaagttgaactaanattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaanntatttctagttaatt

SEQ ID NO: 507 - DNA, 370 bp, Homo sapien
  misc_feature (1)...(370): n = A,T,C or G
cctaactagatcttatcagaataggggggaagggngtcggttcatccttattgagtgttaatgaccctgtaagatgtaatttcttttatttcattctgttacctagaaaatctatcacagccttgtagtattgattgctcaatctataaagagctcagtttacagcatgactgttagtaacagggntattttaatgagtgactcttcaacacctcagagtttcactaaattccaacccatcagcccagtagtctaacattaagggtcttaggaaatgagaacttatcacctttccttatcatgaaaaggtaacctccaggtaaccaaaaatagaacttcctctgtgttcgttttttatagaaattactgg

SEQ ID NO: 508 - DNA, 129 bp, Homo sapien
  misc_feature (1)...(129): n = A,T,C or G
ctgttaaaagaacaaacttagcaatatataacagttnggtaacaggatttttgactattcactttgggagttatttttaaaaatccacttttttactgagtcttactacataccaggcactgtacttgg

SEQ ID NO: 509 - DNA, 422 bp, Homo sapien
  misc_feature (1)...(422): n = A,T,C or G
ntgggaagtcgtgacatccatgggaacccagcgctgtgatgctggtgtttgngttctccgcgagaagtgaccattgttggagcaccatccagagctagtgaccantncagtggacagttagtgggagaatcaaaaatcctttccagaatgtctgtttctcactacntgcaccgggngattacaggcaccagtgcagngatgattgtacttatttgacacatactccccgtcntcctggntnttgttcctganaanggtgggtaaatattccaggaaaaanaatgcacattgaatggatgtgagagaccacattgcctctcccactgctttggggagcactttcctgtcatttctaacttaccacntgcttggtgtactatatgtatgttgtgcctcatatgttgcaaagaactaangtgagt

SEQ ID NO: 510 - DNA, 238 bp, Homo sapien
ccacctatgaattggtggtttacctactcaatggatagcagcacgaggactgctgtactgcacaaaaagaagaccaaaagattacagtggaccatgggatacagaagccagcatggcagacagaagaaaaatagtttgggaacatgtaactatcctaagtggaagttttgttgtaggaattatagtaatcacaccacattacttggcctttcggtaatgtgaaaaaaaaaaaaaatcc

SEQ ID NO: 511 - DNA, 254 bp, Homo sapien
  misc_feature (1)...(254): n = A,T,C or G
ccnattgatttgatggtaagggagggatcgttgnggctcgtctgttatgtaaaggatgcgtacggatgggagggcgatgaggactaggatgatggcgggcaggatagttcagacggtttctatttcctgagcgtctgagatgttagtattagttagttttgttgtaagngttaggaaaagggcatacaggactaggaagcacgataaggaaaatgactatgagggcgngatcatgaaaggtgataagctcttct

SEQ ID NO: 512 - DNA, 269 bp, Homo sapien
  misc_feature (1)...(269): n = A,T,C or G
cctacctgtaaactacagtactttatatatctatgggnttaataaaaanaaaatccacaaatcttaaaaaggaactttaaatgcagggctatattgaattggnaaactgcaacacaaactggcgcaacataggtaaatgaataccaatctcactctatgtgatgcaagcatgctactttcccactaatttaaattactttcaaccactatgagccagaatgcatgcctgaaccttaaactgcactttaaaaagtaacatcttggcctaa

SEQ ID NO: 513 - DNA, 266 bp, Homo sapien
  misc_feature (1)...(266): n = A,T,C or G
ggaggggggttgttagggggtcggaggagaaggntggggaacagctaaataggttgttgttgatttggttaaaaaatantagggggatgatgctaataattaggctgtgggtggttgtgttgattcaaattatgtgntttttggagagncatgncantggtagtaatataattgttgagacgattagttttagcattggagtaggtttaggttatgnaccgtactctaggccatatgtgttgganattganactagtagggctagg

SEQ ID NO: 514 - DNA, 271 bp, Homo sapien
  misc_feature (1)...(271): n = A,T,C or G
acatgcaanaaatcgagaatcttaaaaaacannacgaanctgccctggaanncttactggnntangatatttatnttgcggctgagatacttgaacaacttcggatcngaantagacaanaangggnanttntatactgcnncagaggttacacagntcattgtattagagangaacanatgggtctggtgttcacacattggggggaanatgggcgtnnacangagaggnnganaaacnanganagcctncctggttngcataanaaaaa

SEQ ID NO: 515 - DNA, 328 bp, Homo sapien
  misc_feature (1)...(328): n = A,T,C or G
ccaatgaggggcaaagtgagcgncnagaagangttttgactgaaataaatcaaacacaaaaatntaagttcacagtgacagtttaaacaaaatccaaacaaactaacaacanaaacaccccttgntttgcctctagtggaaggtggganaacacaanctcgtcctaaaaattgactagtaaaggggaaaacccggtcatttncctactctttccangaaatatctaatgcaagaaagaacttctnctcattatacngaaggaatttngaaaaatgatgtatttttggaacacctaantgaaatactggaacctgggcaagttcaccac

SEQ ID NO: 516 - DNA, 220 bp, Homo sapien
  misc_feature (1)...(220): n = A,T,C or G
ncctnagttgaaggaccccatgtacatacaggccaggggagcagtactaggntaactagaaggatctcatccccatatgtgggctcatttcaagtctatggatgactaccttcattgntgtgtgcgagatggtttcaccccttgaaaatatgggcacttcancataanatagcnaaatctttataatgatcaatncatcctacctccttttacatgcatg

SEQ ID NO: 517 - DNA, 296 bp, Homo sapien
tgcgatttcttccttgttgtttgctttggtctgtgttcaatccagagagcttaaattgtcattattttgggaagaaaacctgtatttttgttagtttacaatattatgaaatttcacttcaggagaaactgctgggcttcctgtggctttgttttcttagtttctttttccgtgccgtgtattttttaattgatttttcttcttttacttgaaaagaaagtgttttattttcaaatctggtccatatttacattctagttcagagccaagccttaaactgtacagaatttccactg

SEQ ID NO: 518 - DNA, 299 bp, Homo sapien
  misc_feature (1)...(299): n = A,T,C or G
gaagatagaaaaatataaagccaaaaattggataanatagcactgaaaaaatgaggaaattattggtaaccaatttattttaaaagcccgtcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaagg

SEQ ID NO: 519 - DNA, 464 bp, Homo sapien
  misc_feature (1)...(464): n = A,T,C or G
gctgcacatcggaggaaaactcggtaaagcagaatgaggttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaggtatttcatacagtttaacagatcgggaaacttctgtgaatgtcattgaaggtgatagtgaccctgaaaaggttgagatttcaaatggattatgtggtcttaacacatcaccctcccaatctgttcagttctccagngtcaaaggc

SEQ ID NO: 520 - DNA, 221 bp, Homo sapien
ctgatatctacttatttaacacaagtctctaatacaatacaattttattaattttattccacatgccccacattagatctctagactcattcatcctacatacctactttgtatcctttgacctacatctccctacttcctcctccagtccccaccccccacccactggtgctaaccactgtttcattccctttttcattctacatatgtgagatcatgct

SEQ ID NO: 521 - DNA, 312 bp, Homo sapien
  misc_feature (1)...(312): n = A,T,C or G
ctgatagctttctcttcgcctagattaatatcttctnncttcccattcacagcccccaccgacatcaaagctttgctgttttatctgtcaaaaatgtcttcacacttttcattcttaaataaaagtgctgagtaaggacattttcacaacaaatttttattttacaaaacttacaatgatttgaatccaaaacaactttcattatttaactgtaaagtaaatatatattttattaggngtgtcttagttcattttgtgctgctttaacagtgtatccttgtgatagttgtggggtgggggaggggggaagga

SEQ ID NO: 522 - DNA, 336 bp, Homo sapien
ccttctttccccactcaattcttcctgccctgttattaattaagatatcttcagcttgtagtcagacccaatcagaatcacagaaaaatcctgcctaaggcaaagaaatataagacaagactatgatatcaatgaatgtgggttaagtaatagatttccagctaaattggtctaaaaaagaatattaagtgtggacagacctatttcaaaggagcttaattgatctcacttgttttagttctgatccagggagatcacccctctaattatttctgaacttggttaataaaagtttataagatttttatgaagcagccactgtatgatatttttaag

SEQ ID NO: 523 - DNA, 172 bp, Homo sapien
  misc_feature (1)...(172): n = A,T,C or G
ngacnggcncntggctatgtntatagatagggctttaaccactatctgngaagcangagngacannattcttgctctcacatnccacngganacgtatttctcttctcttacnagcgaagaaccatctntttctaaagcccccattctattgcccttgcttttctctggctt

SEQ ID NO: 524 - DNA, 471 bp, Homo sapien
ccagacctgcagaaaaacttagcacagctcaatctgctgttttgatggctacagggtttatttggtcaagatactcacttgtaactattccaaaaaattggagtctgtttgctgttaatttctttgtgggggcagcaggagcctctcagctttttcgtatttggagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaataagaaaaatgcagcaaacttttaataacagtctctctacatgacttaaggaacttatctatggatattagtaacatttttctaccatttgtccgtaataaaccatacttgctcaaaaaaaaaaaaaaccttc

SEQ ID NO: 525 - DNA, 332 bp, Homo sapien
  misc_feature (1)...(332): n = A,T,C or G
ccccnctgtattccagcctgggtgaccccatctcanggaagaaaagttaccagatgtcgngggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaa

SEQ ID NO: 526 - DNA, 440 bp, Homo sapien
  misc_feature (1)...(440): n = A,T,C or G
ccaggttacctcccctaacagatgtggtgttctgangggttggttaagtgcccgaggaaaataggccttaactgttaacatctacagagaagaaagcatggtcacactggcaaggagtaagaagggattgggtaaaagaaaatgggagagaaaagggaaaaaagttttggcaagacaattgttccctgctaagaagctgcagggtgaaagctttcctttcttctatttttgtttttaatgnctgtctctctgatcagnggaaaagtgaaaatttctagtatctagcactaacgtatgacccaactttgagggatcacaagctagaacaagttgaggatttaaaatcctggataattatatacttaaagttcatgagcataaagctcacttgaccatgcagaaatgctgggaagcagggtgcatggcatgggaatacatct

SEQ ID NO: 527 - DNA, 124 bp, Homo sapien
  misc_feature (1)...(124): n = A,T,C or G
tttccatatgtctgttgggtgcataaatgncttcttctgagaagtgtctgttcctatcctttgccccctttttgaggacttaaatgttagacctaagaccataaaaaccctagaagaaaaccta

SEQ ID NO: 528 - DNA, 162 bp, Homo sapien
  misc_feature (1)...(162): n = A,T,C or G
ctgcgggagaaatatggggacaagatgttgcgcangcagaaaggtgacccacaagtctatgaagaacttttcagttactcctgccccaagttcctgtcgcctgtagtgcccaactatgataatgtgcaccccaactaccacaaagagcccttcctgcagcag

SEQ ID NO: 529 - DNA, 409 bp, Homo sapien
  misc_feature (1)...(409): n = A,T,C or G
cctttaaaatatagcttataaaatgtatactatnngccaggagagctcacatttttctgcagttttccagtggacctgcctatggaatactgtaaagaaaaatctgcaaaaatattcctagcaattgaatcagtgcttttaaataaaagaagtggagaggggcttggttaaattattctgacaagttttcttgctagtggttgccaaaattaaggatatttgaagtgtcctatcacccaaatttggctttaagaaaaagctatattctgngtctatagggtgaagcccacactatctgtgctgcattctcaatgatacaatacctatctggaaactttcctgttttgccaatgggtgcacaaatctaaaacattttatcacaaaaggtacttgaatttaaatttctttt

SEQ ID NO: 530 - DNA, 325 bp, Homo sapien
  misc_feature (1)...(325): n = A,T,C or G
ccgccagtgtgatggatatctgcagaattcgccctttcnagatttgngcccgggcaggtccatggctaggattatagatagttgggtggttggggnaaatgagtgaggcaggagtccgaggaggttagttgtggcaataaaaatgattaaggatactagtataagagatcaggttcgtcctttagtgttgtgtatggctatcatttgttttgaggttagtttgattagtcattgttgggtggtaattagtcggntgttgatganatatttggaggtggggatcaatagagggggaaatagaatgatcagtactgcggcgggtagg

SEQ ID NO: 531 - DNA, 173 bp, Homo sapien
  misc_feature (1)...(173): n = A,T,C or G
ccaattgatttgatggtaagggagggatcgttgaccncgtctgttatgtaaaggatgcgtagggatgggagggcgatgaggactaggatgatggcgggcaggatagttcagacggtttctatttcctgagcgtctgagatgttagtattagttagttttgttgtgagtgttag

SEQ ID NO: 532 - DNA, 395 bp, Homo sapien
  misc_feature (1)...(395): n = A,T,C or G
caggtcctactatgggtgttaaattttttactctctctacngggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcanaaggtataggggntagtccttgctatattatgcttggntataatttttcatctttcccttgcgg

SEQ ID NO: 533 - DNA, 290 bp, Homo sapien
  misc_feature (1)...(290): n = A,T,C or G
ctgaaccattatgggataaactggtgcaaattctttgccttctctacttctcactgattgaacataagcttccagggctcccctgaaaaccaaaatgaaaacaatgtcaaaatattagataaatcacataaaacagttaaggggataccaatatataaaaattattaggtaagctcatttctggaactgttaatgctcggtttcacaatccaagnngaccaacagccttcactcagntactggnagtgntactatggttactacngntactacctttagtgtnaaaaact

SEQ ID NO: 534 - DNA, 334 bp, Homo sapien
  misc_feature (1)...(334): n = A,T,C or G
ccgccagtgtgatggatatctgcagaattcgcccttagcgagnnagccgggcaggtccatggctaggtttatagatagttgggtggttggtggggnatgagtgaggcaggagtccgaggaggttantttgtggcaataaaaatgattaaggatactagtataagagatcaggttcgtcctttagtgttgcgtatggctatcatttgttttgagggtagnttgattagncattgttgggnggtaattantcggctgttgatganatatttggaggtggggatcaatanagggggaaatanaatgatcagtnctgcggcnggtnngacctcngccc

SEQ ID NO: 535 - DNA, 557 bp, Homo sapien
  misc_feature (1)...(557): n = A,T,C or G
nccataagcttcagtgcgcaaaaggtcaaggccagtgttaatttgttatttcttaaataactttccctttcatttttaaattataaatttaacttctaacatgttttatggttaaaattgtacttttttcctttagcgacattcaaatgcatcacaatcactttgtgaaattgttcgcctgagcagagaccagatgttacaaattcagaacagtacagagcccgaccccctgcttgccactctagaaaagtatgtgtaaaactctgttcttgttcttctttcatattgatgctgttccatgtgttaccattgtgagtggttggtaagtgttccttatgtgggaatcatgtgccttgaaaataaccttgggtgggtgagaaggtagggaaacctgcttcttttatctcaagtaaaagttttggcagggtaaagaagataaatgacatttatatctagacttttgagttttccaattatttggtaaaaatgggaaattctgtagaagcccttccttaaaaatgggggaagtccatttnanaaaattaactggtaggtca

SEQ ID NO: 536 - DNA, 372 bp, Homo sapien
  misc_feature (1)...(372): n = A,T,C or G
gttccaaccttcatttctgaaactgttctagagcacngtgtctttctcgtagttcataacttaccccttcagtctagaattagaattacattatctgttttactactttactagactgtaagctcctagaagataaggactagggagttcatctctgtattccaccagaaggtacagtgactcatatctagagtctttagatgaaacttactgagttgaataacttaatatatttctgttttcattcccaagggaggccatgtctggagatagaccttgaatttaataaattttaggcactataccatttcagtggagaaaattgttgggaaatttggggggatggatatataagggggaggaagtcactgg

SEQ ID NO: 537 - DNA, 284 bp, Homo sapien
  misc_feature (1)...(284): n = A,T,C or G
ccttctgatgcaaacagaaaggaaatgttgtttggangccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttgg

SEQ ID NO: 538 - DNA, 293 bp, Homo sapien
gtacatagtaggtgtatatatttatgggctatataagatgttttgatacaggcatgtaatgtgaaacaagcacatcaacaagaatggggtatccatcccctaaaacatttgtcctttgggctacatgtcatttcctaatgtaaagaaaatggacagacagaaccaacattgatttgactgggtgaaaaagtccatttgagttgggagcaggggttgtgttcctggatttgggttgttaggacagtgtaaaaaggcttcacaggggaacattcttttctgataaaggaaagcag

SEQ ID NO: 539 - DNA, 468 bp, Homo sapien
  misc_feature (1)...(468): n = A,T,C or G
tttcnataaactttatttttagagcagttttaagnnggtagcaaaattgattagaaggnacagagatgtcccatacacctcctactcccacacatgcacagccttccccattatcaatagcccccaacagagggatacatttgttaacaactgacgaacctacatatcattatcacccaaagtccacagtttatattattccttctggagaattttcaaatacagaaattcctctaccaggaataaactancaatttcctctcggctttctataaatttaattattatttcagaaattagcctatctttacaggagaaaatgttataaaccatgaaaagactatcaaatacacaaggaagtgaatgntatataaaaaatgtaccatctcctaaacaactacctgcattcccttcttgttggtaagttataatttgnnatagttctgatcatctgtttaattaatttgc

SEQ ID NO: 540 - DNA, 397 bp, Homo sapien
  misc_feature (1)...(397): n = A,T,C or G
ctgttttattaattcccccatttgcagcacacttntctcttccaacattcatcagtcagatcagagtccacggtcttttcaaaatttagataaactggcttacattttgtaatgatgtccccagacaacaccccactccaacccattctgtttgttactattagtttacaacatgcatgtgcctttactttcattttcatagtatttaaaaatggaagggcactcccaaatttactttaacccctttaataatctctctcctcctgctctctctggtcctccagacaactgttgatttactttcctttatgatggattagtttgcattttctagaattttatatgactgacatataaagnttttatgtttctcccctttgggtttcttcatgtggca

SEQ ID NO: 541 - DNA, 248 bp, Homo sapien
cctagataggggattgtgcggtgtgtgatgctagggtagaatccgagtatgttggagaaataaaatgtgcatagtgggggttttattttaagtttgttggttaggtagttgaggtctagggctgttagaagtcctaggaaagtgacagcgagggctgtgagttttaggtggagggggattgttgtttggaagggggatgcgggggaaatgttgttagcaatgagaaatcctgcgaataggcttccggc

SEQ ID NO: 542 - DNA, 366 bp, Homo sapien
  misc_feature (1)...(366): n = A,T,C or G
aatcggccctctagatgcatgctcgagcggccgccagtgtgatggatatctgcagaattcgcccttgagcgatancgcgggcaggtccaattgatttgatggtaagggagggatcgttgaccncgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcgtcttgtanac

SEQ ID NO: 543 - DNA, 460 bp, Homo sapien
cctactatgggtgttaaattttttactctctctacaaggttttttcctagtgtccaaagagctgttcctctttggactaacagttaaatttacaaggggatttagagggttctgtgggcaaatttaaagttgaactaagattctatcttgggcaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggctaag

SEQ ID NO: 544 - DNA, 116 bp, Homo sapien
  misc_feature (1)...(116): n = A,T,C or G
ccgccagtgtgatggatatctgcagaattcgccctttggagngctngcgcccgggcaggtctgtttcagcagctcctccttcttcttcccgcgangatctcgagccttgatcttgg

SEQ ID NO: 545 - DNA, 380 bp, Homo sapien
  misc_feature (1)...(380): n = A,T,C or G
cgacggatcgatnagctngatatcgaattcggacgagcatggcgtattgctgcagatatggattcttcagaatgctccatgacaaatgtactgacgggaagncnatctaaaggaggcattgtnatgagagaaaggtctcgagctccagataaagagagatacagagttcttggaattggagttgcagaaacagtaagacaatcgattgtggggaagcgttcttttagagaatctttggccttcactccaaagcgttgttcttcatcaataataagtagctcgtgccgaattcctgcagcccgggggatccactagttctagagcggccgccaccgcggaggagctccagcttttgttccctttagtgagggttaatttcg

SEQ ID NO: 546 - DNA, 418 bp, Homo sapien
ccagggcaattaggcaggagaaggaaataaagggtattcaattaggaaaagaggaagtcaaattgtccctgtttgcggatgacatgattgtatatctagaaaaccccattgtctcagcccaaaatctccttaagctgataagcaacttcagcaaagtttcaggatacaaaatcaatgtacaaaaatcacaagcattcttatacaccaataacagaccaacagagagccaaattatgagtgaactcccattcacaattgcttcagagaataaaatacctgggaatccaacttacaagggatgtgaaggacctcttcaaggagaactacaaaccactgctcaaggaaataaaagaggatacaaacaaatggaagaacattccatgctcatgggtaggaagaatcaatatcatgaaaatgg

SEQ ID NO: 547 - DNA, 172 bp, Homo sapien
cctgaggttgggagaaattttgtccatttctttagaaccaaaattggcaaccagagagtatttggatgttacacaaaatatctagtttccctttctagcctaaattgggttgtttatagcacccgtctctccatttgagaaaaatggttaggatgctggtgcagggatgagg

SEQ ID NO: 548 - DNA, 367 bp, Homo sapien
  misc_feature (1)...(367): n = A,T,C or G
ggtctgacttaagagaaacaatggaaggcaagaggcagtagaataatatattcaaaagatgcaaaggaaaaaaacctctcagccacgaattccttatccagcaattatttttcaaaaatgaaaataacacaaagacttagccagataaacagaaacattaactgaagttgttgctggcagacctaccatataaaaataaaaaactctaaaaaaattcctatggctaaaagcaagttacagaagacagtcacttgaatccacattttaaaaaaagcactgatatacgtaatattgacattataaaagacagtaaaaatgcatttcttctttataataaatngcttattaaataacatgtgtataatgg

SEQ ID NO: 549 - DNA, 418 bp, Homo sapien
ccaaatcagaacctagagtgagcattctataaactcacctttgctttgatccttgaagatcacaagttttgatactgttgaaatctctactctttcaacactttaattaaatggcatttagaatttcatatacttctgttgttgtttccacaatcttaaactggatttagaaatacttataatgtaaatgcaagagctttaacttagtaaccgtatttcctattttttgttgtttttcttttgccagaatttctgtttgtctacaataaagtccagcgaaatacagtatttggttaggttacttgttaacataaaattttatcatttgtagagtttttacttaaccttcctattctctagtctctataatctttcaatgaagataaccagttacgaatatctcctataccatattagg

SEQ ID NO: 550 - DNA, 234 bp, Homo sapien
  misc_feature (1)...(234): n = A,T,C or G
cctacccgccgcagnactgatcattctatttccccctctattgatccccacctccaaatatctcatcaacaaccgactaattaccacccaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgat

SEQ ID NO: 551 - DNA, 542 bp, Homo sapien
  misc_feature (1)...(542): n = A,T,C or G
cacccctaccccnntcctcataaaagttnctctccctggatcctctttttccctcatgagtgcccggttgcccaagtcaaaaacctgggagtgatataaactccccacacatccagtcagtcactcatcaactctattgattctgtctgctaaatatatntcaattgtattaacttaaacatatgcatanggcactttcttcttcactgcatttttgtgggctgcacttacctttcaggtaacgacaacactggcccctcttgcccttctagtcagaagtgccaaaatgatgagagctagccatgacaaacccacagccaacattacactgaatgtgcaaaactggaagggcatccaaacagaggaggggagagaggaatagacaggaagtcaaactgtctctgtttacagatgacatgtttctatatctataaagccccatagtcttggccccaaagcttcttctgctgataaactttagcaaagtcttagcatacaaaatcaatgtgcaaaaattactaacagtcctatacatcaagtca

SEQ ID NO: 552 - DNA, 411 bp, Homo sapien
  misc_feature (1)...(411): n = A,T,C or G
cctggntgacaaggaggtgcctgtnatgtgaagatttgaggaaagagcattccaggcagggggaaggcttgatgcaaagggtctactgcaggcattagctgagcttatttaaagatcagaatgaaggccattgtggctagaacagagtggacaggaaggaatggtaccaggcaaagctgaagaagttggcaggattgagctctcataantcatggcaaagagttcccatttcattgtttgacggaaataaattggaaggtcttaagtaggagaagatttgattagatttacattttacgaagaagcactctggatgttatgtgaagaaatggcctttgcagggcaagggtggaaacaaagagatcagttaggaaattattggagtagctgaggattggatgaggggatgtg

SEQ ID NO: 553 - DNA, 631 bp, Homo sapien
  misc_feature (1)...(631): n = A,T,C or G
ccgggattagaactaaaacaagtgagatcacccctctaattatttctgaacttggttaataaaagtttataagatttttatgaagcagccactgtatgatattttaagcaaatatgttatttaaaatattgatccttcccttggaccaccttcatgttagttgggtattataaataagagatacaaccatgaatatattatgtttatacaaaatcaatctgaacacaattcataaagatttctcttttataccttcctcactggccccctccacctgcccatagtcaccaaattctgttttaaatcaatgacctaagatcaacaatgaagtattttataaatgtatttatgctgctagactgtgggtcaaatgtttccattttcaaattatttanaattcttatgagtttaaaatttgtaaatttctaaatccaatcatgtaaaatgaaactgttgctccattggagtagtctcccacctaaatatcaagatggctatatgctaaaaagagaaaatatggtcaagtctaaaatggctaattgtcctatgatgctattatcatagactaacgacntttatcttcaaaacaccaaattgtctttagaaaaattaatgtgattacaggtagagg

SEQ ID NO: 554 - DNA, 558 bp, Homo sapien
  misc_feature (1)...(558): n = A,T,C or G
ccaggntagtctccaactcctgaccttagctgatccacccacctcggcctcccaaagtgctgggattacaggcatgagccactgcgcccggccaaacttgatatgcatttttaaataagttaatacattattcatggtttagtctcattatatattctatggtccactttgaaatttcatctaaccaaaatcatcttcatcctgcaatttgaggtttggacacaatggggattgatcagtaatttcttcatatgccctttctcaaggaaatagtttcctatgaaaaaaaagtcctatgttttcatgtaagttctctttttggagaagaaaaggagacattcttacttagcactctcagttttacaaaacgctgccaaccttaaaatttgtctattgattcccaaggcacacaaccaatagtctgtcaataacccggaataacatttctttaaggccccagtaactttcacatgtttgggttccaatcctcacctagaatcttgttaagaaaagtaaaccattcactcctctagaaactctaaggttgcttcttagggg

SEQ ID NO: 555 - DNA, 212 bp, Homo sapien
ccaggtatttgcataatggcttttcttctgttgcctttgttcctttgtggccccagctaattgcctgagagtgccactgttagttttcaactctttctgatagaaaccctgtgtactaacatggaaatcttaggtaatctgctttttcaaagcacaatgcagaatttattggcggtggtgtaactttaagaatatccgagaagccaccaagg

SEQ ID NO: 556 - DNA, 219 bp, Homo sapien
  misc_feature (1)...(219): n = A,T,C or G
ccatgtgtctatctggagagaaggggaaacagcaagtgcaaaggccctgagatggaacatatctggagaattcgaagaatggtaagaaggccagagtggagcagaacaagtgtgggagagagttgtaggagatgagatcaaaggctaggaatgaagtgtaaggccatgtcatgtgaccttgtatgtccttgtaaggcttttttttttttttttnancct

SEQ ID NO: 557 - DNA, 482 bp, Homo sapien
cctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttccatcgcctatactttatttgggtaaatggtttggctaaggttgtctggtagtaaggtggag

SEQ ID NO: 558 - DNA, 679 bp, Homo sapien
  misc_feature (1)...(679): n = A,T,C or G
ctgtnaaaattctgaacctatccccaaaagaaaaaccgtgaaatacaagttttaggaggtggagcaaagaaaagccaagttatttaaaaccaataaacacaagagacaattctgctggagaatttactttctccaaaacatcaaatggactttaaagcagaagaccacattttatgagaaagttatgtcactgaaaagcttcatgtaaagtgactttgtaaatggaatatttttaaatgataaaaagaaaataacttttccaggaatcctttggagaggctgataaccagatattaaattatcaattttgccaaagtggacttttaaaaaatgtgttacttttaaaaactaacttgaaagaatttatgaggcaatctatctgagtatgtttattgttgctccattggctttcaggattttggtcatttcactgttaactcttacatcagagaataaagaaaagaaaatgaaactttgttaggaactgggatggaaaatgtagtcccagacagatctactgacctcgactgagtttcagaaatatcccaggattttggttattcatgcctttcttttgtgactttctttcaaattagccaattaaagataccccttcaatcaccggtgacatcagtacaacagtttttcaacagttttctctctcctgaccaaacagttt

SEQ ID NO: 559 - DNA, 488 bp, Homo sapien
  misc_feature (1)...(488): n = A,T,C or G
ccccactgtactccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaacaagggctgtttttgctgccccaaaagggcttaacaatttaggcggatagtttacttaaaaaaaaaaatcctttggagacatactgaaaatgcaaactagtttctaaattatcaattccctacatgaanaagcagtttgccanagtttagtctcanaaaatgactggttggctctatttaaatcanaacccaatttctacgcacctgcccgcccggccaagggc

SEQ ID NO: 560 - DNA, 602 bp, Homo sapien
  misc_feature (1)...(602): n = A,T,C or G
cctanttaagaattccttgccttagtggtgaacaaggactaaacacagacaatgggtgaaacacagacgctaattcacataacagagagtaggcaaccttaagaatgaattgatgcagactcctatagaattcctctgttatgactgggttcttattttctcctccttgtatgtagttgaaatttcatcattatgaatagttccttggatctttttttaaagttgtgaatgcgagtgtttggctttgtaatacaactttttagtatccagaagataaccagtgctctaccaataaagatcttttgatacaaagggttttaacttctgccagttcttactcatttttttcaggttttttatacatttcttaaacaacacatacattatgtaaaatataagaattaatgtacattctcaaggccagattcagtgacaaaatgcactacccgaatctagtaacacatttactccttgctgcatataagtggcgtgtaagaaatacagggtatattgttttgtgatccatgcagtaaatgttcacaaatatcaggcaaacaactagacgntcttcagctactaaaattaactgtcccagtcacaaa

SEQ ID NO: 561 - DNA, 683 bp, Homo sapien
gtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaagacattactgtaatatcaaaaaccgtggcagtttgtatacaactctgggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgt

SEQ ID NO: 562 - DNA, 420 bp, Homo sapien
gcactttttttccagtaaggattcatctcttgctctcctatatggtcattatattttatattttacatatttataaacatgacatatgtatttatgttccacaaagggctttgaatagaatttacacatagagttccctgggttgatgtgtttatcaaaatggaagataaagtgaattaattacttaaatatttaacactattgaatagaaataatttccccaatattgcttcatgatttagacagtctattaaatgtttaagcaaggcactagactaagtttattaagacaaattttggaatatgtgcagaaatatgacctggctaatagtacagagtcaaagctggttgaatggtgttatatagtggattcagattgatgtggcagtggtggttacactaggggcactaaggttatcc

SEQ ID NO: 563 - DNA, 482 bp, Homo sapien
ctccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgggcctggtgatagctggttgtccaagatagaatcttagttcaactttaactttgcccacagaaccctctaaatccccttgtaaatttaactgttagtccaaagaggaacagctctttggacactaggaaaaaaccttgtagagagagtaaaaaatttaacacccatagtagg

SEQ ID NO: 564 - DNA, 302 bp, Homo sapien
ctggaagtgaaggtactaatatacaaatggctcttgtttctgaatatgtgatataatttgtgaatctttggaaactgaattttttctatggagtgcaaatatagaagggttattttacaatgtttgttgtgaaaagaattcactttgtaaacaactattaaggctggaagtttagtgaaggtgcatagttttgaaagctacacaggtgaaaaatcaaacttattgtttgtaattttgctgttacatgttaagttactttgacagcaattttctaatgataatgtgatttatgatttaaaagg

SEQ ID NO: 565 - DNA, 554 bp, Homo sapien
  misc_feature (1)...(554): n = A,T,C or G
ccanngtgacatcatggcaatacagcaagaattctgnnatttatttagaagcctcaaggagaaggatcctggagcccctgaatgagagtttcttctccatgcctctccccagtcaaaatacatggaaatattcatagaagcattgtacccagcatgataaggaaggatggagaatggttccttatatctctgttcacaagacatcaacactcttaagtaactgtatgaaataaattctctgctgaaagcaaataaaccatctgaaaggtcttctggttacttacacagatttcctagagaatctgaaatcagcctaacagggaagattaatttttaaatgaatccaagttaatgaaagcaaagaactcttatacagaaatacattttcctattataaagcaggactaccttccctaatttctgatagacctaggacaatttgaatgggcattgaaattcttttggttgaattacgcaaacaagcaaaggaaaagtctcaattattattggaaaatttggggagagattattatctcttgatctcctagtnnatt

SEQ ID NO: 566 - DNA, 631 bp, Homo sapien
  misc_feature (1)...(631): n = A,T,C or G
ncgaagctgtgaanncattcacacggaatctgganggtattactgtaacttcttataatacataatataaaagtttttgaaagatatagacacaattaacccctaaacaacacactatctgattctcaaaagcaatggctatttaacaagatgtaaaaggacaataacatatcaaagaactttcacacacctaaagatagcatttagcagcaagttagtcagacaaaacaaacataaatatcttcacatttcctatgtttgtttttaactttacttcataaagccactgataattgaggtttctttcaagtataagatttctaaaattaaaaactgtttttgacatatttttataaagaaataaaaagcaaaacgcaatccaactatttatatgagtccctcttctccaacagctttagatgtttttctgagtactttttacacagaatatttttattaaaatcagttctaattcatttatgcagattaggggaaaatgattcataataaattaactttaaaattaccttctatctgcttctacctctatccccccatcaccaccaaatctgttgctacagtgaactgtagccaatgtctgtttgagggggcccaaagcatctggtaatct

SEQ ID NO: 567 - DNA, 510 bp, Homo sapien
  misc_feature (1)...(510): n = A,T,C or G
cctatnatagcttctctagctatcatactccaatcagcnaaaaatgagaaaatgttgagaaatagaagataattcctcatttaaggncaccttctanaatttgtgcttaanantctgttttcttctcatgggccagcacttcggcaactgggaaaaattangngtacagggatctaggnaatactgtttatttgagcaataatatattgngctaacgttcaggcatcctattactgagaaataagggaaaatgagtgtaaagtacaactaagagtctcggctacagggaaaaataccatcagttaaatatccatagtcctagagcatttatgtaaaactgcaatttgaatcctgcaatacattttggctttttcctcagtgataccatgtgtgggaagttgttctgtcaaggtgggtcggataatttgccctggaaaggacggatagtgactttcctgacatgtaaaacatttgatcctgaagacacaagtcaagaaataggcatggtgg

SEQ ID NO: 568 - DNA, 180 bp, Homo sapien
  misc_feature (1)...(180): n = A,T,C or G
ttaatntgacncacgcttatgcggaggagaatgntttcatgttacttatactaacattagttcttctatagggtgatagattggtccaattgggtgtgaggagttcagttatatgtttgggattttttaggtagtgggtgttgagcttgaacgctttcttaattggtggctgcttttagg

SEQ ID NO: 569 - DNA, 237 bp, Homo sapien
ccaattgatttgatggtaagggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgtcaggaaaagggcatacaggactaggaagcagataaggaaaatgactatgagggcgtgatcatgaaag

SEQ ID NO: 570 - DNA, 352 bp, Homo sapien
ctgtctctccatttagagccccagttggtcctgacctcttacaaatttggtgttttcactttgatgtttatgaaccgattgcattaaaaatgcaggataatgattcagggttagagaaactattatttatacaaatgtggttaacacctcatcattttaaattggctgtgctaataatgctcattgtgctcttcagggttatgtgtgtgtgtgtgtgtgtgttttgcctgaatctgcaacctacatttgctctggcagtatgttgagtatatgctagaatagaatggacctaggcaactctaaggtcctacaactaaatacacttacttaggaaacctcctaaataagtagg

SEQ ID NO: 571 - DNA, 402 bp, Homo sapien
ctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttgtttctaccttgaggtcttttgacatgtggaaagtgaatttgaatgaaaaatttaagcattgtttgcttattgttccaagacattgtcaataaaagcatttaagttgaa

SEQ ID NO: 572 - DNA, 70 bp, Homo sapien
  misc_feature (1)...(70): n = A,T,C or G
tggatccgagctcggtaccaagcttggcgtaatcatggtcatagctgtttcctgtgntcgttttacaacg

SEQ ID NO: 573 - DNA, 423 bp, Homo sapien
ccaatggtttcttagtgaaagagtacactagctctgaatgcaatgccctcagaaagatatcattcatagagacatacaaagcacatggcaacatgacattggaatacacgattctgagcatcttcattcatgaccaacctggctatagatttcagatgtcctcttggctcgaaggatatctgggatatccatgctcacttgcattcctttccctttaatttcattttctaagtccttcttgtattgtttctaaaagaacagaaaataatcttggagctttgcttaagctttaatagcgatgttgaaatttacatgtttgaatctcaaagccacccatgtggaaagaaaacttatgctctttccagctatgattcacggcatttattttaaactttgtatcttgctgctgtcttacctggctgg

SEQ ID NO: 574 - DNA, 129 bp, Homo sapien
ctgttaaaagaacaaacttagcaatatataacagtttgctaacaggatttttgactattcactttgcgagttatttttaaaaatccacttttttactgagtcttactacataccaggcactgtacttgg

SEQ ID NO: 575 - DNA, 684 bp, Homo sapien
  misc_feature (1)...(684): n = A,T,C or G
ccagatntgacttttcaaaactactcacattgtgaaaaangcaggaacaaatctagtttcaagttcagcatgccgttccctgtttaattcataaaacacaactggcagaagtattacttgaagcaaaacaaaagtaacgtgggaacttgcttatttgctaagccacaatgtatttttccaggaatagcataaatttgccatctttcttgtgtctatggaaaaggggtttagaattgtttcactaaaaattaaatttctatattgtcaaacatgattgtatactcaaattttaaaatgtgaagggaacacttactaagcatttcctgggtatgccactatattaagtcctagtaatatgatatagtttatttcaattttttttcaactcatacttcctttaaaatagcactgaccaaaagaaagttaacatgagcttcatgtacaatttttaatctttttgcagaaaaataaactgagaaaggctaaaattgttttatttaagccactataccaagacatattgatttcaccaatataaaaattgagatagtttacattttttggtacatctttaaaatctggtatgtatttttatactgacagcacatctcaatttggacaagctacatttccagggctcaatagtcaccatgaatctcaattgtaatcaaagaggttggcctg

SEQ ID NO: 576 - DNA, 134 bp, Homo sapien
ccttatttctcttgtcctttcgtacagggaggaatttgaagtagatagaaaccgacctggattactccggtctgaactcagatcacgtaggactttaatcgttgaacaaacgaacctttaatagcggctgcacc

SEQ ID NO: 577 - DNA, 133 bp, Homo sapien
  misc_feature (1)...(133): n = A,T,C or G
ctgtctctccattnagaagccccantnggtcctnacctcttacaaatttggtgttttcactttgatgtttatgaaccgattgcattaaaaatgcaggataatgattcagggttaganaaactattatttatac

SEQ ID NO: 578 - DNA, 200 bp, Homo sapien
cctcaaatctatcttcaaaggtgacccagcaatcagtgtcaatgcctttactgtagttaacctggtaatttcattctttagtctctccaagaaaatctgaagtgtattaggcaagtcagaacccaaattgtctccaaggttgcaaataatttgtcccatacaggaaatagccctttccttgacttcctgatcaatgtcag

SEQ ID NO: 579 - DNA, 402 bp, Homo sapien; identical to SEQ ID NO: 571

SEQ ID NO: 580 - DNA, 245 bp, Homo sapien
  misc_feature (1)...(245): n = A,T,C or G
ccaattgatttgatggtaagggagggatcgttgacctcgtctgttatgtaaaggatgcgtagggatgggagggcgatgangactaagatgatggcgggcaggatagttcagacngtttctatttcctgagcgtctgagatgttagtattagttagttttgttgtgagtgttaggaaaagggcatacaggactaggaagcagataaagaaaatgactnttagggcgtgatcatnaaangggataaa

SEQ ID NO: 581 - DNA, 294 bp, Homo sapien
tgcagcgcaagtaggtctacaagacgctacttcccctatcatagaagagcttatcacctttcatgatcacgccctcatagtcattttccttatctgcttcctagtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattgg

SEQ ID NO: 582 - DNA, 230 bp, Homo sapien
gaggtcgccctcatagtcattttccttatctgcttcctagtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattgg

SEQ ID NO: 583 - DNA, 481 bp, Homo sapien
ccaagggtgttctgcctgcctcagcctcccaaagtgctgggattacaggtgtgagccactgtgcctgaccacaggaaaacttatttaaatgagagatttgactcgaaagatcccgtttttttaaggctcttagttcttaaaagcggcacataatagaattagtataatcccaaataaattttcagtagatttttggtgtaacttgagaagatgattctgtcatttttagtgacaatttaaaagacctgaaattgtctacagccatagaaagtgaactactgatagttgtttctgtaaagttttattggaacacaaccacacctatttgttcatctgtattgtctttggttactttgtgcagagaccatggcccacaaacctaaaacattcactttctagctctttaagaaataattggcccactgacaccctggtcttaaggtctagaccaattatttctcaagagtattagctgaatcag

SEQ ID NO: 584 - DNA, 306 bp, Homo sapien
ccaattaagagctaaatttacaaaataatctctatcaggaggctttaaggtttaatgtctctaaagtccctatggatataagaggcttgaatgtactgaattcaaatttggtttttaaatgttataatagtttaggcccgagagccacatatttctgtctaagaatagaaagcatagctagctgcccacacagaatattcatatagaggtggggggcaagaacaaaatttattcatttgatacatagaaatgggactacttagaatagactcataatagaaagcatcatctggtttctcatctcag

SEQ ID NO: 585 - DNA, 308 bp, Homo sapien
ccagaatggtacagagtggagggtgttctgctaatgacttcagagaagtatttaagaaaaacatagaaaaacgtgtgcggagtttgccagaaatagatggcttgagcaaagagacggtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactagaacaccagctcctttataatgcatgtcag

SEQ ID NO: 586 - DNA, 416 bp, Homo sapien
  misc_feature (1)...(416): n = A,T,C or G
cctgtctttgaatggatgaaataggttaataaaaaacatcactgtttaaaaactagaacactgaaaaattctaggaaagcttattttcccttatatttttatggnactttcaacacttnacaacactatttnaattaanntttnttctagagtttatannatatcagtacattcttttctgtggatgcaataatatagaatcttattncaaatcttactggcaggntctnttaaattcttcaacggntgncatagtgattaaccaaaattagttatgatttctgcctatctgtgtgagaacttacaggggaaattgttctaaacctgaggaacatgaagtaactgtactgcacactccaaatgatgacagtcattttatatcaccttcaattacccaacagcttttaatagtctgg

SEQ ID NO: 587 - DNA, 382 bp, Homo sapien
cctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttc

SEQ ID NO: 588 - DNA, 307 bp, Homo sapien
cctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggactaatacccatatttctcgagtagggcaggcaatggcgtccacagaggaaaaagcctatgagatcatgagggagctcgatgtcagctatgtgctggtcatttttggagg

SEQ ID NO: 589 - DNA, 89 bp, Homo sapien
cctgggtgattgaggatgcaatgagctgtgattgtgccaccacactccagcctgggcaatacagcaagactgtctcaaaaaaaaaaaaa

SEQ ID NO: 590 - DNA, 456 bp, Homo sapien
cctcagttcttgattgtggttgacggggcgtcaccatgaaggagcccatttagtataaagcttccaaccttttctcttaatcgtttctttaatcttttaaaccatcttcaagtgcataggggagtttccgatgccagaggatgaaagcaagtgctctctccaccctctcctcccagagtgaaaacaaatccttttgctgatacttgtttcaaaagcatccattgtaaagcttctcagtgacacaaaatactgagaggtaactttttatcaatcaaaccacataccccaatttaacacctttcaatgctctgaattcaactgacagactaaagggtgtttcctgtaacagtctgaaatattaagtgttttttttgttttgtttttaaatcttatttcagaaaacttcctcttggggtaggaaagtacacatgaagcagcaaagtaacgaagaaaaac

SEQ ID NO: 591 - DNA, 289 bp, Homo sapien
ccaattgatttgatggtaagggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcgtcttgtagacctacttgcg

SEQ ID NO: 592 - DNA, 435 bp, Homo sapien
  misc_feature (1)...(435): n = A,T,C or G
cgcgttagatgcgccttttccggcctgtgcgtctgctctggttcctctcaggcagcaaagctggggaaggaagctcaggcaggagcctccccgacaccacagcggcacaagcagcagctaaagcaccgcactttgctctgctaaccttttacttaaatgaggttttgccaaatccacatctggaaccgcatcacacccatttgcaaggatgtttgttctttgatgaaactgcatctctactgcacatganggctttcattgtaggacaagaggagagttcgtttatttttgtaactgttttacatgttccgattanttaatcggnagcttatgtcatttgctatgcctgttgtcttctaatctctccttactaaaacattacttcaaatttnaattgacccttgtttataatttatttaacgggatttgngtgtc

SEQ ID NO: 593 - DNA, 633 bp, Homo sapien
  misc_feature (1)...(633): n = A,T,C or G
ctgtttagtcagataattgtgtccgaattgattangaaaataatagaccagccataaagcagcataaaatattatgaaactattccagaagttcagtaatatctttgggacctgctcatagcccaagttttgtgaatacttttgtagttaaaaaaaatttttactttaccagggcattgcaattcttttccatcagtgaatttcattctacagacttttcagagcatctcataatcagtcaacaaatctatttcaaatgtgtttgttactaagcaacggttgctaagagcttctgtaattaagatgaaagttccaaggtaacaatgcccaaacacagcaccattttcaccattttctgataatgcaggagtaggatggctaaaagtgaaagaagaatctactctatggaaagcatggcacctgaaatttctgaagatattggctgtcctctagcttatatgagagagagtgtttgtgctttactaatcaaccagtcatttttttcttgtgtggctgaaatgtacattccagacatgaacaggtagagtatgtgttgggggcaggtttatactgcatgggtgtgctgagacagggccacgtggtgatgtaaatgatgctgnctgacacgtgcag

SEQ ID NO: 594 - DNA, 501 bp, Homo sapien
  misc_feature (1)...(501): n = A,T,C or G
cctttacaagatgctggtaccttgatcttggacngggcaggctccaagatggaaagaaagtgagcatctgctttttagggattatccagtctatactactctgttctagccacacaaaacaggttaagacagaaattggtaccaagagtggggtgttactacagcaaatacctgaaaatgtagaagaggctttgaaatgtggtaattggaagaagctggtagaatttggaggagtaggctagaaaatgtctgtattttcatgaatggagcattaagaataattccggtgaggccatagggaaagtctaaaacttttcagaaattatgtaagcgattgtgattagtaggttggtagaaatatagacagtaaaagcaattctgatgtggtttcagaggaaaatgaaaaatattagaaactgaaggaaggggcatccttgctataaactggcaaagaacttggctgaaatgtctccatgtccaagagatttatggcagaaatgt

SEQ ID NO: 595 - DNA, 383 bp, Homo sapien
ctggtcaccatcatccctttaatcaactcacacctgtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggccagaggggaggtgacatgtttagagtcacccag

SEQ ID NO: 596 - DNA, 266 bp, Homo sapien
ccatggctaggtttatagatagttgggtggttggggtaaatgagtgaggcaggagtccgaggaggttagttgtggcaataaaaatgattaaggatactagtataagagatcaggttcgtcctttagtgttgtgtatggctatcatttgttttgaggttagtttgattagtcattgttgggtggtaattagtcggttgttgatgagatatttggaggtggggatcaatagagggggaaatagaatgatcagtactgcggcgggtagg

SEQ ID NO: 597 - DNA, 383 bp, Homo sapien
  misc_feature (1)...(383): n = A,T,C or G
ctggtcaccatcatccctttaatcaactcacaccngtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggccagaggggaggtgacatgtttagagtcacccag

SEQ ID NO: 598 - DNA, 266 bp, Homo sapien
ccatggctaggtttatagatagttgggtggttggtgtaaatgagtgaggcaggagtccgaggaggttagttgtggcaataaaaatgattaaggatactagtataagagatcaggttcgtcctttagtgttgtgtatggctatcatttgttttgaggttagtttgattagtcattgttgggtggtaattagtcggttgttgatgagatatttggaggtggggatcaatagagggggaaatagaatgatcagtactgcggcgggtagg

SEQ ID NO: 599 - DNA, 294 bp, Homo sapien
  misc_feature (1)...(294): n = A,T,C or G
ccaattgatttgatggtaagggagggatcgttgaccacgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcanataaggaaaatgactatgagggcgtgatcatgaaaggtgataagctcttctatgataggggaagtagcgtcttgtagacctacttgcgctgca

SEQ ID NO: 600 - DNA, 213 bp, Homo sapien
agatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggtggctgcctttagg

SEQ ID NO: 601 - DNA, 471 bp, Homo sapien
  misc_feature (1)...(471): n = A,T,C or G
ncctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggctaaggttgtctggt

SEQ ID NO: 602 - DNA, 482 bp, Homo sapien
  misc_feature (1)...(482): n = A,T,C or G
tgagcatacagcaataaaaataacataatttntatgtgtacaatatttatggaatacgttactggaacagataaataatttagttaataacatgacaaagaacagaaattgtatacactatacagcatagtaatagaataatgaatgattaaagttattaatattaggtagaaaatgaagggtatctttgagagcagaactcaaggaagcaagcaatttgccttatgaggaaagagttacctgtggataaaggagaaactgaaaaatttacaagtcaagactttttgagcaaaaacaaaaatatgactatgagtcaccaattcagtacagtgaaaaaaaagttgaagagatatcttggaagtaaaccatgttgtggaagagcagggttttgataatcatgggattattctgaatgaattttaaatgcgataggaatatatgagataatttcaccagagaataatatgatcatgtttgcattt

SEQ ID NO: 603 - DNA, 372 bp, Homo sapien
gttccaaccttcatttctgaaactgttctagagcactttgtctttctcgtagttcataacttaccccttcagtctagaattagaattacattatctgttttactactttactagactgtaagctcctagaagataaggactagggagttcatctctgtattccaccagaaggtacagtgactcataactagagtctttagatgaaacttactgagttgaataacttaatatatttctgttttcattcccaagggaggccatgtctggagatagaccttgaatttaataaattttaggcactataccatttcagtggagaaaattgttgggaaatttggggggatggatatataagggggaggaagtcactgg

SEQ ID NO: 604 - DNA, 468 bp, Homo sapien
  misc_feature (1)...(468): n = A,T,C or G
gcngttttgagtgagtttcttaatcctgagttctggnttgattgcactgtggtctgagagatagtttgttataatttctgttcttttacacttactgaggagagctttacttccaagtatgtggtcgattttggaataggtgtggtgtcgtgctgaaaagaatgtatattctgttgatttggggtggagagttctgtanatgtctattaggtccgcttggtgcagagttgagttcaattcctggatagccttgttaactttctgtctcgttgatctgtctaatgttgacagtggggtggtaaagtctcccattattattgtgtgggagtctaagtctctttgtaggtcactaaggacttgctttatgaatctgggtgctcctgcattgggtgcacatatatttaggacagcnagctcttcttgttgaattgatccctttaccattatgtaatggccttgnctcttttg

SEQ ID NO: 605 - DNA, 288 bp, Homo sapien
ccaattgatttgatggtaagggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcgtcttgtagacctacttgc

SEQ ID NO: 606 - DNA, 572 bp, Homo sapien
  misc_feature (1)...(572): n = A,T,C or G
gaatnaaatgaatgaaatagaaaatataattgagagcttcaacaacagactataccaaatggaggaaaaaatttctgaacttgaagatagatcttttgaaataacacaagcagtggcaaaaatgaattaaaaagaataaggaaagcctaaaggatttatgagatatcattaagcaagcaaatattcatactatgggcattccagatggaaaaaagaagggtaaaggtgaggaaatcatatttaatgaaataatagcagaaaatttccggagtcttgggagagagatgagcatttaggtccagggagctcaaagaaccccaaacagattcaacccaaacaggtcctctctggagcccaacatagtcaaattgtaataagtaaaagacaaagaattccaanaagcattcaagagaaaagagtcaagtcataaataagggaatctccattaggctaacagcagatatctcagcagaaagcttacangccangagagaatgggatgatatattcaaagtacttgaaagcaggggtnggggaaaccctgctagctaaaaatattatacccttgcaaa

SEQ ID NO: 607 - DNA, 178 bp, Homo sapien
  misc_feature (1)...(178): n = A,T,C or G
ctcggggtaatctcccagcaagaggtcaggtcctggntgtgcgtcccagggtgtcagtgaaattggctgctcccctgacccagggcaccttcatgcgtcttcacagcaggactactgtgaccaaggccagacctttcatctttcaaaagactttgactaaaaatgctttaaaaaagca

SEQ ID NO: 608 - DNA, 416 bp, Homo sapien
cctgtctttgaatggatgaaataggttaataaagaacatcactgtttaaaaactagaacactgaaaaattctaggaaagcttattttcccttatatttttatggtactttcaacacttaataacactatttcaattaagttttctcctagagtttatagtatatcagtacattcctttctgtggatgcaataatatagaatcttattccaaatcttactggcaggttctcttaaattcttcaacggctgtcatagtgattaaccaaaattagttatgatttctgcctatctgtgtgagaacttacaggggaaattgttctaaacctgaggaacatgaagtaactgtactgcacactccaaatgatgacagtcattttatatcaccttcaattacccaacagcttttaatagtctgg

SEQ ID NO: 609 - DNA, 648 bp, Homo sapien
ctgatctctcagcagaaactcttcaaaccagaagagagtgggggccaatattcaacattcttaaagaaaataattttcaacccagaatttcatatccagccaaactaaccttcacaagtgaaggagaaataaaatcctttacagacaagcaaatgctgagagattttatcaccaccaggcctaccctaaaagagttcctgaaggaagcactaaacatggaaaggaacaaccagtaccatcgaggctaggaagaaaccgcatcaactaaggagcaaaataaccagctaacatcataatgacaggatcagattcacacataacgatattaactttaaatgtaaatggactaaatgctccaattaaaagacacagactggcaaattggataaagagtcaagacccatcagggtgctgtattcaggaaacccatctcaccgtgcagagacacacataggctcaaaataaagggctggaggaagatctaccaagcaaatggaaaacaaaaaaaggcaggggttgcaatcctagtctctgataaaacagactttaaaccaacaaagatcagaagagacaaagaaggccattacataatggtaaagggatcaattcaacaagaagagctaactatcctaaatatatattgcaccc

SEQ ID NO: 610 - DNA, 310 bp, Homo sapien
ccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttacacaaactgttttgaggctcttaccgtagtcgaaggtatcttagatcttccttagtgatctcattaagaatatccgaaagtgtataaccctcttcaacaatctgaaacaaagatcagatccttaagagctgagcag

SEQ ID NO: 611 - DNA, 254 bp, Homo sapien
  misc_feature (1)...(254): n = A,T,C or G
ctgtttttacatctaaagcaatagactagaactgaattntcttctacatagtaaaatcacaattgtggaattacaggaattctggtgatattaaggtgaaacaacaaaacacaaaaggccctattttaacagttgatgtgacagtaagttttaatagaacctgtaacttcattttggaaatgcttctccaccaaataaggcctttttcccctatttaaggagccagatggattgaaagatgtggaaataggcag

SEQ ID NO: 612 - DNA, 225 bp, Homo sapien
  misc_feature (1)...(225): n = A,T,C or G
ctgactatatcatgtcaccatcatagccaatacaacattnttgccatacttcctaaaaaccttttcgcatacactgatcatgctacttatcagcactttctaacatcctgaccaaacagacacccacacctcttatagagtacactgtgagagaataacatggacttgatatggcatcacacttgttttaaagcaaaaaaaaaagaaaaagaaaagaaaaaaaaa

SEQ ID NO: 613 - DNA, 471 bp, Homo sapien
  misc_feature (1)...(471): n = A,T,C or G
ccatcagacttcttgggtgcctggctatattcaatgtgaagtaaaaaatatcccaagtcttacaccaaaatagaggctctgacttagaagtatgcttttagctttctttttaaataagacattctggaagaaaaaaaaagaaaaaggaaagaaaatcaagtttgaaacacagttaacacttattttggcaagaaagcaaccaaaatctaaaaagcataaactatgngtccaaatgnaaaaggnattacagaacaaactgcaagaggggaaaattaaagccncactgaacgaaaaaatacagtatgtctaacattttggaattgnaatttaaaccctaagggcaaaagctgaaaaatcatgcttanacctnggncgngaccacnctaagggcgaattccancacactggcggncgttactagtggatccnanctcggtaccaagcttggcgtaatcctnggcatagctgttt

SEQ ID NO: 614 - DNA, 421 bp, Homo sapien
gttattttttagaatggctctcccatcttgagtatgtgtgatgtttcctcatgtatgaatgaagcatatacatctttgtcagaagtatcccagaagcaattctgtactctcctcattatgttctattgggtgggccatggtttttgatttgtctcattactgatgatggttacttttattatttgataaaggttgtatataacttatctattatggcataatacattagctaaaaccttggcggtgtaaaacagcagatacttacgtttctcataggaatggctctattgagtacctctgtctcaaggcttctcaagagtttgtagctaccttgttggctggggttgcggtctgacctaaaggcttagttagggggtggtagaaatcttccatatgttctttgctacgtggacctcacagg

SEQ ID NO: 615 - DNA, 242 bp, Homo sapien
cctcctatttattctagccacctctagcctagccgtttactcaatcctctgatcaggatgagcatcaaactcaaactacgccctgatcggcgcactgcgagcagtagcccaaacaatctcatatgaagtcaccctagccatcattctactatcaacattactaataagtggctcctttaacctctccacccttatcacaacacaagaacacctctgattactcctgccatcatgacccttgg

SEQ ID NO: 616 - DNA, 392 bp, Homo sapien
  misc_feature (1)...(392): n = A,T,C or G
cctaatttgtagattgtgaaagcagcttttagtttaacttatttacagaccccttataattaccatgtttttttttttnttcctaaatctnttggttcagcttgngaatnttacgtgcccgtaaagtngggatgttgaatnggcccttntttgttctggcagngagtcaagngtccancattttttcataagngttttttaaaatngttctccancattttatggctcctccctcccatgtcctcaaacccagcaaaagcgtanaggcanaattanaggacccncccgggcggccgntaagggcnaattccagcncactggcggccgttactagnggatccnagctcggnnccaagctnggcgtaatcatggncatagctgtttcctgtgan

SEQ ID NO: 617 - DNA, 215 bp, Homo sapien
cctactatgggtgttaaattttttactctctctacaaggttttttcctagtgtccaaagagctgttcctctttggactaccagttaaatttacaaggggatttagagggttctgtgggcaaatttaaagttgaactaagattctatcttggacaaccagctatcaccaggctcggtaggtttgtcgcctctacctataaatcttcccactatttt

SEQ ID NO: 618 - DNA, 433 bp, Homo sapien
  misc_feature (1)...(433): n = A,T,C or G
cttttgtntgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacccataatggatttggttaatgacttatgagcaagctggtttgg

SEQ ID NO: 619 - DNA, 259 bp, Homo sapien
ctgcagtgtccctttttatatcatgctagtgttgagacatacttgactaacttgggaacagttcgatatattgacaaccgtcaacttaagaaaatcaacagcttttggccccagcgtccaagtgaacttttcatggagtgcagaatctcaaatggacaaaatactttgtctttttaaatactgaaaatttaattattagtactatgactgaaagattcttcatggctaaaaagctctgcatcaaactcaattcaggagg

SEQ ID NO: 620 - DNA, 393 bp, Homo sapien
ccaccaaagccacacggagattctgtcaggcgctgagacaccacagccttttcaatcttagggaaagaaatcaagtcatataaattaatatcaacaggtaaggtcattgagcaattgtctttcaactgtctaagactttatcacttaagatcataaacacagaagcaggtcataaaaatagcttttcttaaggtttaggagaatttgtaggggcacttacttgataatctgaattttctagtcagaagtttaaataccaccttttaaaaacataaaatttaatttgtaacaagttattaacaaagcagtattgtcgaaagttttaagctttctcccaataatttaattacattaattaaatttttaccattctaatggttacaaagtaaccag

SEQ ID NO: 621 - DNA, 563 bp, Homo sapien
ctgacaatgataaaattatctctatatgggcaaacgcgtgctctttgtcgaagaagaaagcttcagcttcatgttccaggtgagttaattaggcaatgtatgaatgctaatatctctttcacatattttgcttaagatctgtcttaggactctcgtctggcccatatggttttccaagggcagaagggcctctttttgatgagaggcagttttcagtaactcttaaagtgataacagcaaaggagaggagagagaagagtaagacaaatcgaaacattcttcaattgcttcttggccttttggctaagctcaagctcaaaacaggtcttcaaggagaaaatacatcacaaagaaaaggatgttttatttcttaccttgtcctagaaaaatttccataaactctattggcttaattctgtaaacttgaccaatatcagagtgcttcctaccaaggagggtagctgatgagcgtgaccatggtacatcctagaagaatgtgtgatgaagaagctttcaccgtgtaaaagagttgaaaattattcaaggagacattatggtcttgg

SEQ ID NO: 622 - DNA, 505 bp, Homo sapien
  misc_feature (1)...(505): n = A,T,C or G
tcttaagtgtgtttaatagataaagtaaactttcctagtcaagggttagatttttattatctcttgtgttccgactttctacttttcaactttgaacttcaaaaaaacattactttgcttatcctttgtactttgatcaggttgtttagaattgtagatcaaaccattctttgatcattttattgtttaaatgnttagttccatttataatttttatagccaactctcggttatttctgtcttttgagattgcaattcagaagctgtatgtcgaagtaatttatgagttgacttttatacttaggcttctttaaatactaatagtcaagaattctagagcatctaataaaaaattaactttcagatcattgggaatctgtcctcatttaaatatgtgtaaatgcatttccacagcaaattgcttcatgccctttgnctataaggaaattattccttgtagctaatacatttttcattttgcagnccaaatcttttttgagaaagg

SEQ ID NO: 623 - DNA, 489 bp, Homo sapien
cctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgctatactttatttgggtaaatggtttggctaaggttgtctggtagtaaggtggagtgggtttg

SEQ ID NO: 624 - DNA, 233 bp, Homo sapien
gttggggaacagctaaataggttgttgttgatttggttaaaaaatagtagggggatgatgctaataattaggctgtgggtggttgtgttgattcaaattatgtgttttttggagagtcatgtcagtggtagtaatataattgttgggacgattagttttagcattggagtaggtttaggttatgtacgtagtctaggccatatgtgttggagattgagactagtagggctagg

SEQ ID NO: 625 - DNA, 459 bp, Homo sapien
ttcgagaacatttttaataaataatgtgacaaaattacttttctgattattggattttcagtatgcaaaattatggctaaaaataaggggcttcttacatgaacataatgaaaacattaatcacatggattgttcccttagtactgcacgccttttctatggaactttttcaaattatctaaatgaacaagtttggttttggtgaacaccagcctttttttttgtggttcagttttgtttggctttgtcttccactggggtcagacctgatacttatctatctatgaataaatgtacatttttttcttcaaatagcaccaattataaaatcaatgatattcataaaatgacaaaaaaggatcatagaaatctactagtcagagggcatcatttgtcaattgaaagcaagtaatgcctctattagagattttaaggaaatcttgtaggtttcgacattgg

SEQ ID NO: 626 - DNA, 458 bp, Homo sapien
cctgatgattgttttaaacagtagaaagggttcagctaagaactacagtccactctcagccctgtcatgtactataggacaagtcttcattcacaacaaatggatagcaacaccaatctcgtaacactgggaaaactgcatacaatatttagaaggaacactaatacagcagaatctgcacacaacggagtcaaagatctgaggccaaatcctactacactttacgactttgagttggtcacttttctgaaccttagcttctccatcagtgtaaaactgatgtaaaataatataaagctatatgaaagctgatgtgatttacttgtgaaatagtatgtgcaaaaggactttgtaaaatgtaaagcactatgctggttattgtgatatctgagatatttttaaagttgcaattcaattcaacaagcattcatttagagtcatgtgcaaggcactgtgct

SEQ ID NO: 627 - DNA, 393 bp, Homo sapien
  misc_feature (1)...(393): n = A,T,C or G
ccatnngaacgcactcaggaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatatagcagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacatttgattggaccgacatatacctgtgggctaggacttccagga

SEQ ID NO: 628 - DNA, 233 bp, Homo sapien
  misc_feature (1)...(233): n = A,T,C or G
ctggatttataaaatagttgaatgacaaaagaagnntgttttgacagtaaaaaaaagacattatggacaaaatatgcaaaatgtgcaaagaaaaaataaatttgcattagaaaggtgggcatttgatctctgagccctgtgccatgtaacattgccatgttctttcactgttgtttgaatgttgtaccccancccttgactctggacttaaggcaagctatgactggctttgg

SEQ ID NO: 629 - DNA, 450 bp, Homo sapien
  misc_feature (1)...(450): n = A,T,C or G
ccnggacaatntaggcaggagaaggaaataaagggtattcaattaggaaaagaggaagtcaaattgtccctgtttgcagatgacatgattgtatatctagaaaaccccattgcctcagcccaaaatctccttaagctgataagcaactccagcaaagtcgcaggatacaaaatcaatggacacaaatcacaaacattcttatacaccaataacagacaaacagaggccaaatcacgagtngaactctattccaattgctttcaagaaaattaaaatacctagggatccaacttacaagggacatgaaggacctcttcaaggagaaactacaaaccactgctcaatgaaataaaagaggatacaaagaaatggaagaacattccatgctcattggtagcttgatggggatggcattgaatctataaattaccttgggcagtatggacctca

SEQ ID NO: 630 - DNA, 486 bp, Homo sapien
cctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggctaaggttgtctggtagtaaggtggagtggg

SEQ ID NO: 631 - DNA, 211 bp, Homo sapien
tttacataaatattatactagcatttaccatctcacttctaggaatactagtatatcgctcacacctcatatcctccctactatgcctagaaggaataatactatcactgttcattatagctactctcataaccctcaacacccactccctcttagccaatattgtgcctattgccatactagtctttgccgcctgcgatgcagcggtagg

SEQ ID NO: 632 - DNA, 293 bp, Homo sapien
  misc_feature (1)...(293): n = A,T,C or G
cagcgcaagtaggtctacaagacgctacttcccctatcatagaagagcttatcacctttcatgatcacgccctcatagtcatttttccttatctgcttcctagtcctgtatgcccttttcctaacactcacaacaaaactaactaatactaacatctcagacgctcaggaaatagaaaccgtctgaactangctgcccgccatcatcctagtcctcatcgccctcccatccctacgcatcctttacataacagacgaggtcnacgatccctcccttaccatcaaatcaattgg

SEQ ID NO: 633 - DNA, 263 bp, Homo sapien
  misc_feature (1)...(263): n = A,T,C or G
nggtctgcagtgtccctttttatatcatgctagtgttgagacatacttgactaacttgggaacagttcgatatattgacaaccgtcaacttaagaaaatcaacagcttttggccccagcgtccaagtgaacttttcatggagtgcagaatctcaaatggacaaaatactttgtctttttaaatactgaaaattnaattattagtactatgactgaaagattcttcatggctaaaaagctctgcatcaaactcaattcaggagg

SEQ ID NO: 634 - DNA, 491 bp, Homo sapien
cctactatgggtgttaaattttttactctctctacaaggttttttcctagtgtccaaagagctgttcctctttggactaacagttaaatttgcaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggctaaggttgtctggtagtaaggtggagtgggtttgg

SEQ ID NO: 635 - DNA, 270 bp, Homo sapien
ccaattgatttgatggtaagggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcg

SEQ ID NO: 636 - DNA, 383 bp, Homo sapien
cctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcc

SEQ ID NO: 637 - DNA, 537 bp, Homo sapien
  misc_feature (1)...(537): n = A,T,C or G
ttttaatcctggggtatataggcagnactttaaattgcaaagtcttccgggcctattttcctctacatttttgtaattaactctgggggcttacttgttttggcagtactgaaatcaaaggagctggttcttcttttctcccaattattttcatatgaaagcacctacaattagcctgttagtcctattcagatacatcaaatatcagtgaatgctttactattcgcacatttaagcatctttgttttacataaaattagagtatgaaaaccagtgttcaattttttatcttgttgagcttgtaaaatgccagcaatttaaaactaggacttttccccccataagccaaggaggtagaattactaatacaagggttaaagaaggtagattttgttttcaatatttgggtaatattagaaagattcttcccacagggaagaactagcaagtgtcccaattttttccaaacgttggggaggggaaaattcactgtatcatgaaaccctaagggtttgngtgcacttcctgctttttagg

SEQ ID NO: 638 - DNA, 445 bp, Homo sapien
  misc_feature (1)...(445): n = A,T,C or G
ccagcagaacacagnagtgatttggtcccgtttgttccccagtggggtatctatccttgtgcagggcacaagcctacatggtggctctggtcatatcattagaaaatagacagaaatgggctgcacaccagaatgaatgaattgaattgaaagggaggagtgatggtggaaaaaaaaacaagtcaattcatttagactggtagaaccagaaccactgtgtagtacatccaaacggttaaaattccctggaagatgttacataatcctatcatggtgtttatttatggaaatctattttaaaaattttatgtaatactgcacagtctgtttgcatgatgccttgtacgtagtagcaactcagtaaatactttttgaatgaactagtatagtattttaattagctagtcttcgtgtactggtacaaaagaacagtgtcatcttacag

SEQ ID NO: 639 - DNA, 584 bp, Homo sapien
gcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcaagaggtggcgaaacccgacaggactataaagataccaggcgtttccccctggaagctccctcgtgcgctctcctgttccgac

SEQ ID NO: 640 - DNA, 404 bp, Homo sapien
ccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatataggagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacattgattggacgacatatacctgtgtgctaggatttcaagtatttggtgtctgg

SEQ ID NO: 641 - DNA, 138 bp, Homo sapien
  misc_feature (1)...(138): n = A,T,C or G
ctgtgacaggaacattacctgaagtgcagggtggttacctgcacaaagtcccatttccaaaaatttctgtgtaattcaccagaaattttggatggaataattagaaaaaaaaaaagaggttaaaacntgtaactcaaa

SEQ ID NO: 642 - DNA, 381 bp, Homo sapien
  misc_feature (1)...(381): n = A,T,C or G
ctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcctaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtanaaattaaaa

SEQ ID NO: 643 - DNA, 403 bp, Homo sapien
ccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcattggaactggcacttattttctgaccatcgctgctgttgctctgtgagtcctagatttttgtagccaagcagagttgtagagggggataaaaagaaaagaaattggatgtatttacag

SEQ ID NO: 644 - DNA, 688 bp, Homo sapien
  misc_feature (1)...(688): n = A,T,C or G
cctatttatttgttttggccctggatctttcctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagcttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgcttttcttcaaacctgncagctcaactgangaaagacaggtacttccattgc

SEQ ID NO: 645 - DNA, 484 bp, Homo sapien
  misc_feature (1)...(484): n = A,T,C or G
ccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggtactaaaaaagagaataacatgaaaacgcccagggttacttgaatgtttttataagataggaatatatgtcttcaccatgggggggggtctcggatttcactaacgttgtatatgaaaatgggtgcnataaaaagtacttttaaactttgt

SEQ ID NO: 646 - DNA, 447 bp, Homo sapien
  misc_feature (1)...(447): n = A,T,C or G
gggtcgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgnacaccattgtgtgtttgtaaaatgtgtatgtccc

SEQ ID NO: 647 - DNA, 388 bp, Homo sapien
gaaggtgatataaaatgactgtcatcatttggagtgtgcagtacagttacttcatgttcctcaggtttagaacaatttcccctgcaagttctcacacagataggcagaaatcataactaattttggttaatcactatggcagccgttgaagaatttaagagaacctgccagtaagatttggaataagattctatattattgcatccacagaaaagaatgtactgatatactataaactctaggagaaaacttaattgaaatagtgttattaagtgttgaaagtaccataaaaatataagggaaaataagctttcctagaatttttcagtgttctagtttttaaacagtgatgttttttattaacctatttcatccattcaaagacagg

SEQ ID NO: 648 - DNA, 632 bp, Homo sapien
  misc_feature (1)...(632): n = A,T,C or G
cctggctgggcntttgacctgcgnttttaaatnactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagatagatgtcaaagnatgattggtggagggagcaaggttgaagataatctggggttgaaattttctagttntcattccgtacatttttagttagacatcagatttgaaatattaatgttacctcctcaatggggtggtatcagacctgcccgggcggncgnntc

SEQ ID NO: 649 - DNA, 300 bp, Homo sapien
  misc_feature (1)...(300): n = A,T,C or G
nggtgaagatagaanaaatataagcgaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggctttggaagagttagaagaatttggaagg

SEQ ID NO: 650 - DNA, 498 bp, Homo sapien
  misc_feature (1)...(498): n = A,T,C or G
ngtnctgntaaacagaagggtacaangcccttctggctttaagcagtcataggaatgtgacagacattcctcttagggagcgcctcctcctagggtttcctcatctgtctcacactgagtggatgtaatgctattttaatcctgctgtggcccccaatactagtacttgtccataccttcttgcatttttagcgtctgctctgtggggttgttaggccctggcactcccaggaactagtgctaaagctgcatctntctctcccctctagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacag

SEQ ID NO: 651 - DNA, 654 bp, Homo sapien
  misc_feature (1)...(654): n = A,T,C or G
ctgagggtccccaggtttctaaagctctcaggacgagaaagtaggtcccaagataaggagcctaaagggcttttttctttctgtgtattccttcttggcctccaacatgggtacagtcacaagagcatgtaacagagaagaaggactanacctaccattttctggataaagaattggaaagaggatccacaggtaaccaaaaagtaccagggaaatggcagagaaggaaaacctcaggagaccaacctcataagtggtatttattagngcctgggctcaaatccaaattgtacatgaatatgtctggtcctagatagggtaccgaagactttgaaagtgaattttggtatatcattgcccagattccagactggntattgtgtgacacaacatacaggatatatctgaatagtgctcagaagagtttgaaaatgcaaatgatattaaaataaagatgaaaaagagaaagctggtcagaacttgtggacataacccttctggatctgtngcctgattaaaaaatagttgatattctcgaatgaattaaaacaagatttagagactgagcatggtagctnattcttgtaatccaacnctttgggagggcaaggcaanagaattgcttgcggccaggagttttgagaccagcttggg

SEQ ID NO: 652 - DNA, 293 bp, Homo sapien
  misc_feature (1)...(293): n = A,T,C or G
ngtctgttgcactgaggtgactaaggatacattttgaggaagtagctccaagaacatttccattttcactgtgccttcacatacatctaatggaaatgaacagcacccttcatccatccacggaagcgattaagaaaagggtgggatggaaaaattaacccaacaatattagatcaatacgtagtatttaagngtccataatgtgccaggctgaagatgcacgggaaaaccacactagccggtctgtcaagggcttgagaataccataaacaagaaaacagacgaaccaattt

SEQ ID NO: 653 - DNA, 294 bp, Homo sapien
  misc_feature (1)...(294): n = A,T,C or G
ngtccaccactgcagccctacatacagttgaaaaaaaattccattctgttaacatttgttttataagttttcacgcaatacacaaaaaacccctctgcacttcttgtaaagaacaaaaaagatacacaacagttaagcgtaaagatcacaggcaatagcattcaaacatggatgtgggtagagaaaggagtacctggcatgagtacctgcttagtttgactgaatccttgatttttaatttggcttttcatgggccgctcacaacaccaacgctgtgtgaggtatggtagtcag

SEQ ID NO: 654 - DNA, 250 bp, Homo sapien
ctgtccttgaacaagtatcaatgtgtttatgaaaggaagatctaaatcagacaggagttggtctacatagtagtaatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgagg

SEQ ID NO: 655 - DNA, 494 bp, Homo sapien
ccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcag

SEQ ID NO: 656 - DNA, 477 bp, Homo sapien
cgcgttactgtacatattgctagcaggagacaactggaaatactaaacaaatactggaattcacattacagacagacgaaaccaacatggatgccacacataacttcctttgtagtttcacagagggcctatttgtggttgctcaggtggggtcatacattgcttgcagaaatggcctgatcatagctctatgaaacaatgaattcggaatgaaatcttaccatgacacctctctgtaggaaagaaatgttgcttcacgtgtgctaagttgagataataatatttcacatatttatatacagagaatcactctcaaatttaacccaagataagcaataggatttgggggtgacttgtacacatttctaacaacacttttcttttttctagaggtcactctcaaacactgatatatcactatagtttgagtgtagggattcagtaatcaaaggttgttattgcaaaagagccaggcag

SEQ ID NO: 657 - DNA, 576 bp, Homo sapien
  misc_feature (1)...(576): n = A,T,C or G
cctctacctgtanatcactatttttctaaagacaatttggtgttttgaagataaatgtcattagtctatgataatagcatcataggacaattagccattttagacttgaccatattttctctttttagcatatagccatcttgatatttaggtgggagactactccaatggagcaacagtttcattttacatgattggatttagaaatttacaaattttaaactcataagaattctaaataatttgaaaatggaaacatttgacccacagtctagcagcataaatacatttataaaatacttcattgttgatcttaggtcattgatttaaaacagaatttggtgactatgggcaggtggagggggccagtgaggaaggtataaaagagaaatctttatgaattgtgttcagattgattttgtataaacataatatattcatggttgtatctcttatttataatacccaactaacatgaaggtggtccaagggaaggatcaatattttaaataacatatttgcttaaaatatcatacagtggctgcttcataaaaaatcttataaacttttattacc

SEQ ID NO: 658 - DNA, 344 bp, Homo sapien
  misc_feature (1)...(344): n = A,T,C or G
cctgaaaagaaagntgctcttatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccag

SEQ ID NO: 659 - DNA, 230 bp, Homo sapien
ctgctttccctgctaaacagttccagagcaaaagcagcaaaaagaaaatatgggagggatatgggcaacgtatactcgaacgtacgcagagaagagagtacggttagctctaatatttctcattgaacttggtggtatgtgccttccctgcatataaggccatagtgcttttttgggagcgctagaatatccatccacttgacagtgaccacaaaataggctgtttccag

SEQ ID NO: 660 - DNA, 80 bp, Homo sapien
ctggtccttgttaaactcgatcaccactttggagagatcgactggaggctcctgggtgttctgaggggcctgggggacag

SEQ ID NO: 661 - DNA, 535 bp, Homo sapien
  misc_feature (1)...(535): n = A,T,C or G
ctgaaccatatctgattaactctttggtctctgttattggaacaaaaccgacgctatgcctgcagccgccagactgcaaccaaaaacacagtttggggtcagaagacattaaaaatcacaataaaataggatgaatgttctaagtcacgcaactgaatcaaggcacctttttttttcaaaagcaaaaagttgtttaacaatattccagaatagtagatacttcaaaaaccagattacagtatatatcattttgctgcacattttagtctattttctgtatacatagtcacacattctttaccctctcccaacttatacatgctttatccccccagtcatgtgctatgtaggtataaaaaaataaagttgtatctaaacaagtgatttaaaaaaaaaaactaacgaatgccncnatnataacnctgaacttgtttccctnttgaaggacattggaaatgttaccgaggttnntttacctnggccgcaaccncnctangggcnaattccagcncactgggggccgttactaggggat

SEQ ID NO: 662 - DNA, 257 bp, Homo sapien
cctgactaaagcacatatcacactccctacacttccatgttttctctcccatgtggaccctctgatgcatatcaagattcaagcgcctgttgtagcccttcccacagtcctcacatttgtatggcttttctacactgtgaactttttcttgcactttagagaatgaattctgtacaatgttcttcccatgctgctcacatttgagaggtgtttctctgctgtggcgtctctgatgggtcagacgagttgaggaccag

SEQ ID NO: 663 - DNA, 516 bp, Homo sapien
  misc_feature (1)...(516): n = A,T,C or G
ccaattataggtattttattttttaaagattagagngttcttgaagctctttctatttctttgtcaatgaactaaacattggcaaatatgtagggtttcccacataagaacattattaacatcaaaatagaaagctggtggtagaaataatgattgggaacacagagtctctactcagcgttctacttctgccataccataactttgtgatctcacgaaatatctctccatgttctcatccctatgtatagttctgtcatttttcaataagagctttttgcttaattatgaagtactagttactataaccattattttgagcttcatgtaaatcaagaacacatggactccacttgcaaaacattgaaaatgtagttagggattgggggcaaaaagcaacattttaaaatgtgtaaagacaatgagtaagcaacaaagtgtccaattttttaggcgaaagttgcatatgtcaggaaaaggcaggattaagtaatagagaatttgaatgataactgg

SEQ ID NO: 664 - DNA, 212 bp, Homo sapien
gtccgaggaggttagttgtggcaataaaaatgattaaggatactagtataagagatcaggttcgtcctttagtgttgtgtatggctatcatttgttttgaggttagtttgattagtcattgttgggtggtaattagtcggttgttgatgagatatttggaggtggggatcaatagagggggaaatagaatgatcagtactgcggcgggtagg

SEQ ID NO: 665 - DNA, 408 bp, Homo sapien
  misc_feature (1)...(408): n = A,T,C or G
atccaggggtncccggtngctgcngggaaacctccagccttgttcttcaaaccactcagctcatgtgttttgcgctgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggggggnnaacngnaannaaaatntttntgangtngggtctataagcacccttgangggatntgttaaaagngncatnaangggggattctcntttngcaaaaaaatntaannatcaatttatananctttatttttnactttnt

SEQ ID NO: 666 - DNA, 635 bp, Homo sapien
  misc_feature (1)...(635): n = A,T,C or G
ctgaagnacaagggtcaggcaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaaccttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttanctctcgaatgtcattggaatcttcacctcacagtggngttgaaactgctatagcctaagcnggctgtttactgntttncattagcaggtgctcaccatgtctttggggtgggnggggggagaaagaaagaan

SEQ ID NO: 667 - DNA, 388 bp, Homo sapien
gaaggtgatataaaatgactgtcatcatttggagtgtgcagtacagttacttcatgttcctcaggtttagaacaatttcccctgtaagttctcacacagataggcagaaatcataactaattttggttaatcactatggcagccgttgaagaatttaagagaacctgccagtaagatttggaataagattctatattattgcatccacagaaaagaatgtactgatatactataaactctaggagaaaacttaattgaaatagtgttattaagtgttgaaagtaccataaaaatataagggaaaataagctttcctagaatttttcagtgttctagtttttaaacagtgatgttttttattaacctatttcatccattcaaagacagg

SEQ ID NO: 668 - DNA, 498 bp, Homo sapien
  misc_feature (1)...(498): n = A,T,C or G
tgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttattcgtttaaaaagatttaaaaatcattgcactttggtcagaaaaataataaatatatcttatgaatgtttgattcccttccttgctatttttattcagtagatttttgtttggcatcatgttgaagcaccgaaagataaatgatttttaaaaggctatagagtccaaaggaatgttcttttacaccaattcttcctttaaaaatntctgaggaatttgttttcgccttacttttttttcttctgtcacaatgctaagnggtatccgaggttnttaatatgagattt

SEQ ID NO: 669 - DNA, 622 bp, Homo sapien
ccttagccaaagaatgcagtggagccttcccccttcaactgcattgtgaatgaataccaattaacagcataaaaattaatagtcccatatcagatctggaaggggtttctggggctgtctgatgtccctatcctgttgtagtgaacacaatagcagaaaattctttctgggtccatctgctataaagtcttggtaaaacagcattactatgaagaggatgaactcacctaccttcagatggaggaaaagtgaaaaggacttaggctttagtcctccatgacttttcttaagcactacctacctgtaataagctgagtgcaaaaggatgccgaagaaaatctgcacccagaagctgttagaaagcactgcagagaacagggtatgaagaaaataaagagttcttaataaacccttaagattctttgttcaaggtaaccttgccaaaagggcagagtaggtggcaaagagttgcttttaatctagctctacactgcatttgaaaataaaatttgcccattttgaatatattgtttataattaaatgtgctttttacactgcaggtcaatataaaaactggttagtaaatttccagcgagcatttatgttcatttgctcacagca

SEQ ID NO: 670 - DNA, 477 bp, Homo sapien
ttgggccctctagatgcatgctcgagcggccgccagtgtgatggatatctgcagaattcgcccttgccgcccgggcaggtgatggatgaggagcaaaaactttatacggatgatgaagatgatatctacaaggctaataacattgcctatgaagatgtggtcgggggagaagactggaacccagtagaggagaaaatagagagtcaaacccaggaagaggtgagagacagcaaagagaatatagaaaaaaatgaacaaatcaacgatgagatgaaacgctcagggcagcttggcatccaggaagaagatcttcggaaagagagtaaagaccaactctcagatgatgtctccaaagtaattgcctatttgaaaaggttagtaaatgctgcaggaagtgggaggttacagaatgggcaaaatggggaaagggccaccaggctttttgagaaacctcttgattctcagtctatttatcag

SEQ ID NO: 671 - DNA, 127 bp, Homo sapien
gtgtgtgtgtctacttgggcgtgtttaacgtgtgcgtttgtgtctgcgtgtgcatgtgtctgtgtgtgcgcgtgtatttcagtttgggttgccggatcccatatgattgcgtgcctgtgtacctgag

SEQ ID NO: 672 - DNA, 400 bp, Homo sapien
gggtctgcacagctatgttaacagcatccttataccaggagtaggaggaaagacacgactggaaaagcaattcaagctggtcacacagtgtaatgcaaaatatgtggaatgtttcagtgctcagaaagagtgtaacaaagaaaagaacagaaactcttcagttgtgccatctgagcgtgctcgagtgggtcttgcaccattgcctggaatgaaaggaacagattacattaatgcttcttatatcatgggctattataggagcaatgaatttattataactcagcatcctctgccacatactacgaaagatttctggcgaatgatttgggatcataacgcacagatcattgtcatgctgccagacaaccagagcttggcagaagatgagtttgtgtactgg

SEQ ID NO: 673 - DNA, 600 bp, Homo sapien
  misc_feature (1)...(600): n = A,T,C or G
ctggcgttgctcattagtgaatgtatgacagcaggatgtgaggggatgcccaggagtcagtgttagcattgtcatctgagatcactgctattaatatcatccattaatttattagtgagcttcactatatgcagactgggagataaggagaaaatctgtcacattctctctagctaatcagatcagctaccaattaatgagattctgaatgaaatatcaatatgtgtttttctaatttggacctaggacagagctgttgcttgtcatagagaaaaacaataatgcttaaacatagcacattataattaaagcaggtttctcacatacttttcattttatcctttggataattttgtgaggaacgcaggacaccaacttccctttcatagatacaatccccatgctattgatgaaagtgtttttgaatgaagccatacaacaaataactgatcaaagtggcattacaccaaaatttcttagtaggactcctgcatagaatgtttagatagacgtgaaaagtttgttcangaggaccagcaagagagaaactgggttctttgggagggtttcggtgctacatttataccctncatcagagtn

SEQ ID NO: 674 - DNA, 140 bp, Homo sapien
ggtggttggtgtaaatgagtgaggcaggagtccgaggaggttagttgtggcaataaaaatgattaaggatactagtataagagatcaggttcgtcctttagtgttgtgtatggctatcatttgttttgaggttagtttga

SEQ ID NO: 675 - DNA, 245 bp, Homo sapien
gttgggtggttggtgtaaatgagtgaggcaggagtccgaggaggttagttgtggcaataaaaatgattaaggatactagtataagagatcaggttcgtcctttagtgttgtgtatggctatcatttgttttgaggttagtttgattagtcattgttgggtggtaattagtcggttgttgatgagatatttggaggtggggatcaatagagggggaaatagaatgatcagtactgcggcgggtagg

SEQ ID NO: 676 - DNA, 621 bp, Homo sapien
  misc_feature (1)...(621): n = A,T,C or G
ctgtccccagggnaaatagtngaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggcgtggggaagggtgaatggttttgggaataattcagtgcacacctggggg

SEQ ID NO: 677 - DNA, 210 bp, Homo sapien
  misc_feature (1)...(210): n = A,T,C or G
tttacataanatattatcagcatttaccatctcacttctaggaatactagtatatcgctcacacctcatatcctccctactatgcctagaaggaataatactatcactgttcattatagctactctcataaccctcaacacccactccctcttagccaatattgtgcctattgccatactagtctttgccgcctgcgaagcagcggtagg

SEQ ID NO: 678 - DNA, 383 bp, Homo sapien
  misc_feature (1)...(383): n = A,T,C or G
gtaggagtcaggtagttagggttaacgagggtggtaaggatggggggaattagggaagtcagggttagggtggttatagtagtgtncatggttattaggaaaatgagtagatatttgannaactgattaatgtttgggnntgagtttntatatcacagccanaattntatgatgnaccatgtancgaacaatgctacagggatgaatattatggagaagtantctantttgaagcttagggagagctgggttgtttgggttgnggctcantgtcagttccanataataacttcttggtctaggcacatgaatattgttgtggggaanagactgataataaaggtggatgcgacaatggattttacataatgggggtatnagtt

SEQ ID NO: 679 - DNA, 371 bp, Homo sapien
aaaatgaaaatattgacaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaagg

SEQ ID NO: 680 - DNA, 176 bp, Homo sapien
cctaggattgtgggggcaatgaatgaagcgaacagattttcgttcattttggttctcagggtttgttataattttttatttttatgggctttggtgagggaggtaagtggtagtttgtgtttaatatttttagttgggtgatgaggaatagtgtaaggagtatgggggtaattatg

SEQ ID NO: 681 - DNA, 152 bp, Homo sapien
ctggagatggatatgagactagtcaagatgtgaatgctaattggagagaaatataattttaggaagatgcacattgatgtggggttttgatgtgtctgattttgactactcaagctctgtttacagaagaaaattgaatggcgagggtgtgg

SEQ ID NO: 682 - DNA, 141 bp, Homo sapien
ccagtgcttgcttgccgtggtttagtgattgggtgttagaaataaaaactcaggtctatttcttaccagtcagtaacaatttttagagaatgtacttggtatataatatatggacttcaggaactttgttggggtgggggg

SEQ ID NO: 683 - DNA, 308 bp, Homo sapien
ccagcaatggtacagagtgagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtatcaaaaaactagaacaccagctcctttataatgcatgtcag

SEQ ID NO: 684 - DNA, 277 bp, Homo sapien
tggtattaggattaggatgtgtgaagtatagtacggatgagaaggttggggaacagctaaataggttgttgttgatttggttaaaaaatagtagggggatgatgctaataattaggctgtgggtggttgtgttgattcaaattatgtgttttttggagagtcatgtcagtggtagtaatataattgttgggacgattagttttagcattggagtaggtttaggttatgtacgtagtctaggccatatgtgttggagattgagactagtagggctagg

SEQ ID NO: 685 - DNA, 457 bp, Homo sapien
  misc_feature (1)...(457): n = A,T,C or G
ctgtggcgtnccctacttctcccaaacctcgcaactccctcccaggacagtcagtgccaaagaaacaggtcgctgaaaactaaaatgtccacatccctaactggcaacccacatcaaccccaaaaggttgaagaatcatctaagatatttcagatgctctatgaagaaattcactttaacacttataactgtaagactttgcatacattacaacagtgcattagtgatacaagttgtaaaatacgtttccattcctttggattttgcatatgatggttttgcatcagtcactgcaggtagattgagcaagctttttgtgtttgtttttttaaacatgcattcaactagatatgattcagaatagattaatactccctttttatcactacagttagctaaaaaattgccaggcagtccacaaaacagaatttgctttaagaccaacccacagagtcag

SEQ ID NO: 686 - DNA, 234 bp, Homo sapien
  misc_feature (1)...(234): n = A,T,C or G
ntggatttataaaatagttgcaatgacaaaagaagtatgttttgacagtaaaaaaaagacattatggacaaaatatgcaaaatgtgcaaagaaaaaataaatttgcattagaaaggtgggcatttgatctctgagccctgtgccatgtaacattgccatgttctttcactgttgtttgaatgttgtaccccagcccttgactctggacttaaggcaagctatgactggctttgg

SEQ ID NO: 687 - DNA, 315 bp, Homo sapien
  misc_feature (1)...(315): n = A,T,C or G
nngtctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgngtgtcatatcctattttgtgatgatggggattctgaccatttatacctcatataaggagaagagcatctttctcgtggcccacaggaaagatcctacaggaatggatcctgatgatatttggcag

SEQ ID NO: 688 - DNA, 522 bp, Homo sapien
  misc_feature (1)...(522): n = A,T,C or G
ctgaattagaggaggagaaaagaagccattnnggagtactttaattgtttagatgtgagaggctgaatgtttgggttaagatgttagttgtcagaatcatgagaaaaggttttaagcaaggggcatttctaattctaaaaataacaactactgttatttattgagcactatctttttgttgggtactgtctaaagtacttgatttattttttaaaaccttacaaaaaacttacaaggtaggtactgaaagattcagtaatttgttcaaagtcacacagcaaataagcaacagactctggatttgaaccaggcaatcctagagcctgtactgttagtaattatactttagcacctgtcaagaattcctgttgagtgtcaagaagcaancaccaagttaggatttaaagcaaacatgattgaagaatactgtggtgtggttgacagtagtgcctaagtctgttttcagagtgaaaaatgacaaattagattttaagtatggtttggagataatatcaggacagt

SEQ ID NO: 689 - DNA, 158 bp, Homo sapien
  misc_feature (1)...(158): n = A,T,C or G
tctcaacttantntnatacccacacccacccaanaacagggtttgttaggnattgtttgcattaataaattaaagctccatagggtcttctcgtcttgctgtgtcatgcccgcctcttcacgggcaggtcaatttcactggttaaaagtaagagacag

SEQ ID NO: 690 - DNA, 300 bp, Homo sapien
  misc_feature (1)...(300): n = A,T,C or G
tagaactcgtatttttaaacttctattctctanccttttccactacattatgacacaagaccctgcagaaagtcgtctggaaaatatcagaccatctcttacttgtcccatccaatcttacatcgaattatatgcacccttaaaaagttatttggagttttaaaaaactctattagcccaaattacctgaaataaactcctggcttgttcccctaatgtttataaaaaattgattgaaaatattcattttaaaaatgaagntcttgaatttatttaaattactgtcttgcagtgagttgg

SEQ ID NO: 691 - DNA, 305 bp, Homo sapien
ctgttcagaaagctcattggacctggttttgaaaataaaacaaagttaaaaccctgggaggagttattgtgcagtgtggagtactcaggctttcttataaagaaaaaaaaagttatctggtaccaaagtgtgcaacctacagaccctcaggtactgccctgtgacttctctgtatgacatcacaaggctgccaagtgcctgtttttctagaactaggagttggtgaggtttggctagtgctgaaaccatgcataggattggtttactaaattaaaaccttattacgtacgtcctccaaaagacag

SEQ ID NO: 692 - DNA, 582 bp, Homo sapien
caggaaatggataaccattttaactgtattttttgcagcccgtaccttcttgggaatacaattgtctaactttttatttttggtctggctgttgtggtgtgcaaaactccgtacattgctattttgccacactgcaacaccttacagatgtggaagatgtgaaatttgtcatcaattatgactaccctaactcctcagaggattatattcatcgaattggaagaactgctcgcagtaccaaaacaggcacagcatacactttctttacacctaataacataaagcaggtgagcgaccttatctctgtgcttcgtgaagctaatcaagcaattaatcccaagttgcttcagttggtcgaagacagaggtgcaggtaaggatgactgataggaaatgttggtagttacgagtcacatcgttgtctacaaatccatttaaatggtattggagggtgagtaaaaccttgaatgtgaaaacttaagctgaaaaattgtaaaaacatttcacgcctaccatgaatagatctgtttctttctgtccacaatgatttgtgtcatagacataattgatcaatttgcaattg

SEQ ID NO: 693 - DNA, 275 bp, Homo sapien
ccaattgatttgatggtaagggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcgtcttg

SEQ ID NO: 694 - DNA, 397 bp, Homo sapien
  misc_feature (1)...(397): n = A,T,C or G
nggtctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccag

SEQ ID NO: 695 - DNA, 609 bp, Homo sapien
  misc_feature (1)...(609): n = A,T,C or G
ctgagcttccatttgtcagctagcactgnggtagtcaaccatgcgaatgaggctattttggacctcatgattgtccagtgcctgggctgataccgngggaaacgaaattttgtggctgcccacaaaatcatggaaaataatgattttttagaaaacctccactgntttgttgtgcagcaataaataactgaaacaccaatccaaaaaacttataaagctataacaattaaaacagnataataatagtnccgggatacaaaaatggtcaaattgaagaggatacaaagcctcaaagcagtcctcactcataananccttgttgtatcactaaaanggcattaaaattgagaanaaggaanaactagtggattaattaataaatgagaagtatccataaggaaaaattaaaattnnattcttgcttcacattatgaaaaaatacaaacaacagattgattaaagacttaaatgngatcaacaaaatgttaaaactgtgataagaacatttaagaaaatagttctatnaccctgggataaaacattttcntccaaggcattaaagtgttaaatgaaaagactgatncatttattcattagaatttaaattcn

SEQ ID NO: 696 - DNA, 300 bp, Homo sapien
ctgcaaaataagcgtgctaaattaaattgtcttaaggtttttccacttcattttgtgactttgtgtggttcgaatttctcagtattttaaccagtgtgttgatgttaaagtcaaaggctgcagtatgtctatattcttgctgtactcattggtagtttcagtatatgtaatgtgagtttaaatagtgaaattgtatctcatattaacatttcaaatgctcatattgaaaatggaaaatagtaaacacgggaattgattttattctggttgtctataatacttcattttaaatgtaaatgg

SEQ ID NO: 697 - DNA, 391 bp, Homo sapien
  misc_feature (1)...(391): n = A,T,C or G
nngtcatgtntgatgnatctgancaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagnaaggcatggttgtggttaatctggtttatttttgntccacaagttaaataaatcataaaacttgaacaaaaaaaaa

SEQ ID NO: 698 - DNA, 536 bp, Homo sapien
  misc_feature (1)...(536): n = A,T,C or G
ctgagcatacagcaataaaaataacataatttttatgtgtacaatatttatggaatacgttactggaacagataaataatttagttaataacatgacaaagaacagaaattgtatacactatacagcatagtaatagaataatgaatgattaaagttattaatattaggtagaaaatgaagggtatctttgagagcagaactcaaggaagcaagcaatttgccttatgaggaaagagttacctgtggataaaggagaaactgaaaaatttacaagtcaagactttttgagcaaagacaaaaatatgactatgagtcaccaattcagtacagtgaaaaaaaagttgaagagatatcttggaagtaaaccatgttgtggaagagcagggttttgataatcatgggattattctgaatgaattttaaatgcgataggaatatatgagataatttcaccagagaataatatgatcatgtttgcatttcaaaggggtgtatctggtgcactgngtagaataaataggntatgtgagcaagt

SEQ ID NO: 699 - DNA, 419 bp, Homo sapien
  misc_feature (1)...(419): n = A,T,C or G
ngtccacctgagggcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccag

SEQ ID NO: 700 - DNA, 336 bp, Homo sapien
ccacttattgtccttaaaaatccatactgatacatggacagtaagtgtgttttcagatggagtaccagcaccgaaaatgggttgagggaggatgggttgtatgtatgtttctgcccactaattttgagcagccatattatgaattaaatcgtcacagccaagtaataacccaagaatggtatgagtttcatgtgtaatagctcaaatggaataagcatgaatgctggagtggaccattatcctcaaatattctatgtcacttctcatttaaagactcttgttatgaactattagaaactttaggcaaaatcaaaagtatttgcggcaaaataaagg

SEQ ID NO: 701 - DNA, 418 bp, Homo sapien
ccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaagg

SEQ ID NO: 702 - DNA, 261 bp, Homo sapien
  misc_feature (1)...(261): n = A,T,C or G
gggcctgttgtgggggtgggggaagcagggaggggaacagctaaataggttgctgttgatttggttaaaaaatagtagggggatgatgctaataattaggctgngggtggttgtgttgattcaaattatgtgttttttggagagtcatgtcagtggtagaaatataattgttgggacnattagntttagcattggagtaggtttaggttatgtacgtagtctaggccatatgtgttgganattgagactagtagggctagg

SEQ ID NO: 703 - DNA, 261 bp, Homo sapien
  misc_feature (1)...(261): n = A,T,C or G
gggcctgttgtgggggtgggggaagcagggaggggaacanctaaataggttgctgttgatttggttaaaaaatagtagggggatgatgctaataattaggctgngggtggttgtgttgattcaaattatgtgttttttggagagtcatgtcagtggtagtaatataattgttgggacnattagntttagcattggagtaggtttaggttatgtacgtagnctaggccatatgtgttggagattganactagtagggctagg

SEQ ID NO: 704 - DNA, 381 bp, Homo sapien
  misc_feature (1)...(381): n = A,T,C or G
ngtntgaattctattaaagatacaaagaggagctggtaccatttcttctgaaactattacaaacaactgaaaaggtggaatttctccctaattcattttaggaggccagcattatactgataccaaaacctggcagaggtacaataataaaaggaaacttcaagtcagtatcactgatgaacaccaatgtgaaaatcctcaataaaatactggcaaactgaattcagcagcacatcaaaaagctaatccaccacaatcaagtcagcttcatccctgcgatgcaagtctggttcaacatatgcaaatcaataaatacaattcatcagataaacagagctaaagacaaaattcacatgattttctcaatagatgcagaaaagg

SEQ ID NO: 705 - DNA, 477 bp, Homo sapien
ctgaaccctcgtggagccattcatacaggtccctaattaaggaacaagtgattatgctacctttgcacggttagggtaccgcggccgttaaacatgtgtcactgggcaggcggtgcctctaatactggtgatgctagaggtgatgtttttggtaaacaggcggggtaagatttgccgagttccttttactttttttaacctttccttatgagcatgcctgtgttgggttgacagtgagggtaataatgacttgttggtgattgtagatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggtggctgcttttagg

SEQ ID NO: 706 - DNA, 266 bp, Homo sapien
  misc_feature (1)...(266): n = A,T,C or G
ccatggctaggtttatagatagttgggtggttggtgtaaatgagtgaggcaggagtccgaggaggttagttgtggcaataaaaatgattaaggatactantataagagatcaggntcgtcctttagtgttgtgtatggctatcatttgttttgaggntagtttgattagtcattgttgggtggtaattagtcggttgttgatgagatatttggaggtggggatcaatagagggggaaatagaatgatcagtactgcggcgggtagg

SEQ ID NO: 707 - DNA, 358 bp, Homo sapien
  misc_feature (1)...(358): n = A,T,C or G
ccatcagagaaatgcaaatcaaaaccacaatgagataccatctcacaccagttagaatggcaatcattaaaaagtcaggaaacaacaggtgctggagaggatgtggagaaataggaacacttttacaccgntggtgggactgtaaactagttcaaccattgtggaagtcagtgtggcgattcctcaaggatctagaactagaaataccatttgacccagccggccaatattcaacattcttaaaggaaagaattttcaacccagaatttcatatccagccaaactaagcttcgttagtgaaggagaaataaaatactttacagacaagcaaatactgagagattttgtcaccaccagg

SEQ ID NO: 708 - DNA, 491 bp, Homo sapien
  misc_feature (1)...(491): n = A,T,C or G
cctactatgggngttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggctaaggttgtctggtagtaagggnggagtgggtttg

SEQ ID NO: 709 - DNA, 460 bp, Homo sapien
  misc_feature (1)...(460): n = A,T,C or G
nggttttttttgtagagcaaataatttatgcaaaatatgttacaaaatctgggatgctaaatagttgacacaagtactgtgtttgacatttagtttcatttgaattagtaatagaatttgctccttccaacatttacatcttttttctttctgactttatatattttcaataaaaatttgctccacagtttttaagntcattcttcttgaatccgnttttacatttgctgngacaaacctgcataaaactagattttatagatataacttctttggaagagataaaaattcaaaagtttgacattgctttcanttattcttttcttcattgttttgattggcccctgttagattgatgtattgccaatctacttttgatggcatgaatntaaaatgacaacataaaaagcncttctagtgcaacagtaattgaaacttgcagttttccattaaaaaaaaa

SEQ ID NO: 710 - DNA, 542 bp, Homo sapien
  misc_feature (1)...(542): n = A,T,C or G
ctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcatagatcctactatgcgattaacactgtttatgtatatggacaagagaaatacttgttgttgcatgatatctcagaatcggaatttctaactgaagctgaaatcatttgngatgttgtatgcctggtatataatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtnaggatatctttgttaaattgacaacaatggacctg

SEQ ID NO: 711 - DNA, 394 bp, Homo sapien
  misc_feature (1)...(394): n = A,T,C or G
caaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactanaaataactttgcaaggagagccaaagctaagacccccgaaaccagacgagctacctaagaacagctaaaagagcacacccgtctatgtagcaaaatagtgggaagatttataggnagaggcgacaaacctaccgagcctggtgatagctggttgtccaagatagaatcttagttcaactttaaatttgcccacagaaccctctaaatccc

SEQ ID NO: 712 - DNA, 552 bp, Homo sapien
  misc_feature (1)...(552): n = A,T,C or G
gaggtctgtanaatgccaggctcaaatttgtctttataatttaataccagaaatctttcccttgtgatgtttctttctttctggattgcctctatagcaggggatagcgggggaggataaggcacatctttgntgtactgagaaatttgaccacgcaggatgatgtggctgttctcattcatctgcacagagaaaaataatgataaaatatccctttcctatgtttactgattttatggctgccataatggaagcctccttgactatttaatcctttctgtcaactaggttcgattttttttttaatttacctgttagaggtatttaanaattttaactagctanaaataattacattccaaaggaacaccaaggcaaataaatggttggtaatcagcaaaagaattacattagttgttgntgctacttattagggggagaactgtttttttttaaatttaaacaatttaataatctcaactgcaaataattttagatgcagcaaaggactatgtagncgttaatacctcatgttgatattttcataatatt

SEQ ID NO: 713 - DNA, 518 bp, Homo sapien
  misc_feature (1)...(518): n = A,T,C or G
ccaaaaactggaagcagctcactaaacaaacagtggcatacccatagaactgcatacttctcagcagtatgaaagaatgagctacttatataagcatcattgataaacctcaaaaaaaaaatgccacatgaanaaacccaaagggganaaacataaaaactttatatgtcagtcatataaaattctanaaaatgcaaactaatccatcntaaaggaaagtaaatcaacagttgtctggaggaccananagagcaggaggaganagattattaaaggggttaaagtaaatttgggagtgcccttccntttttaaatnctatgaaaatgaaagtaaaggcncatgcatgttgtaaactaatagtaacaaacanaatgggttggagtggggtgttgtctggggacatcattacaaaatgtaagccagtttatntaaattttgaaaagaccgtggactctgatctgactgatnaatgttggaagagataagtgtgctgcaaatgggggaattaataaaacag

SEQ ID NO: 714 - DNA, 281 bp, Homo sapien
ccaattgatttgatggtaagggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcgtcttgtagacc

SEQ ID NO: 715 - DNA, 443 bp, Homo sapien
cttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcccgacatggagtctgatatacgttcatgggaattgtttctttctaatgttacaaaagaaattgagaaagcaaagtctcagtttgaagaacaaattaaggcaattaaaaatggttcccggctcagtgaactttctaaagtgcagatttctgagctttcatttcctgcctgtaacacggttcatcccgagttactccctgagtcttcaggccacgatgg

SEQ ID NO: 716 - DNA, 639 bp, Homo sapien
  misc_feature (1)...(639): n = A,T,C or G
ccaaanaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacnaaatggaagaatttangattctaaatgaccaaaacanagcattaaaatcagaagttcagaagctgcagactcttgtttctgcacangcctaataaggatgntgnggaacaaatggaaaaattg

SEQ ID NO: 717 - DNA, 473 bp, Homo sapien
  misc_feature (1)...(473): n = A,T,C or G
nntgaggctactgctgttttattacaacattacctcttgtttttataaagtgtaccaagatttaaattgataactttattttacttgaaaaaaaaaagtttnttttatcaccagtgttacagttgtcttctgtttctttttgttttgntttatttgntttcctttttagccaaagagtgaacagaanattttcttattttggtggctattcattttacttttaaaagtgattggtggattttagactaattatgggggaatttgccaccaaaataaaaaatatgtaaagngtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcactgtctgcatttggttcctggttgg

SEQ ID NO: 718 - DNA, 207 bp, Homo sapien
ggtaaatgctagtataatatttaccatctcacttctaggaatactagtatatcgctcacacctcatatcctccctactatgcctagaaggaataatactatcactgttcattatagctactctcataaccctcaacacccactccctcttagccaatattgtgcctattgccatactagtctttgccgcctgcgaagcagcggtagg

SEQ ID NO: 719 - DNA, 255 bp, Homo sapien
  misc_feature (1)...(255): n = A,T,C or G
cctatattacggatcatttctctactcagaaacctgaaacatcggcattatcctcctgcttgcaactatagcaacagccttcataggctatgtcctcccgtgaggccaaatatcattctgaggggccacagtaattacaaacttactatccgccatcccatacattgggacagacctagttcaatgaatctgaggaggctactcagtagacagncccaccctcacacgattctttacctttcacttcatcttgcc

SEQ ID NO: 720 - DNA, 455 bp, Homo sapien
  misc_feature (1)...(455): n = A,T,C or G
ccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaanaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagctccatagaaaaggcgtgcagtactaagggaacaatccatgtgattaatgnttncattatgttcatgtaanaagccccttatttttagccataattttgcatactgaaaatccaataatcagaaaagtaattttgccacattatttatnaaaaatgttcc

SEQ ID NO: 721 - DNA, 530 bp, Homo sapien
  misc_feature (1)...(530): n = A,T,C or G
ccagtgcttgctgccgtggtttagtgattgggtgttagaaataaaaactcaggtctatttcttaccagtcagtaacaatttttagagaatgtacttggtatataatatatggacttcaggaactttattggggnggggggttaattttgccttaccctgttcactttcagatgattaggcttttgcactttagaatgagaaacttgtgacgttagtgtgttcttactagctttaatttgtatgtagcaatgaattgtgaatcttagtgcagtgggtttttttaaaaaactcaaaaagctgggaattaagtggtttcagtaataatgctataccgaggtgcttgcattgtatttcataattttgttacaaaccaaaattatttttaatganaacggtcttgggttcagaggtgtgatgccagaatgtattttcgtactgttaggcccttggaacagataccggtgctttcttgaaagatgaaagaaatgcaatgggtgctcttcatgcaaggttgcaaacctaccaagaat

SEQ ID NO: 722 - DNA, 242 bp, Homo sapien
  misc_feature (1)...(242): n = A,T,C or G
ccaagggtcatgatggcaggagtaatcanaggtgntcttgtgttgtgataagggnggagaggttaaaggagccacttattagtaatgttgatagtagaatgatggctagggtgacttcatatgagattgtttgggctactgctcgcagtgcgccgatcagggcgtagtttgagtttgatgctcatcctgatnagaggattgagtaaacggctaggctagaggtggctagaataaataggagg

SEQ ID NO: 723 - DNA, 472 bp, Homo sapien
  misc_feature (1)...(472): n = A,T,C or G
cctactatgggtgttaaattttttactctctctacaaggttttttcctagtgtccaaagagccgttcctctttggactaacagttaaatttacaaggggatttagagggttctgtgggcaaatttaaagttgaactaagattctatcttggacaaccagctatcaccaggctcggtaggtttgtcgcctcnacctataaatcttcccactattttgctacatagacgggtgtgctcttttagctgttcttaggtagctcgtctggnttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggctaangttgtctggtag

SEQ ID NO: 724 - DNA, 292 bp, Homo sapien
  misc_feature (1)...(292): n = A,T,C or G
nccaccactgcagccctacatacagntgaaaaaaaattccattctgttaacatttgttttataagttttcacncaatacacaaaaaacccctctgcacttcttgtaaagaacaaaaaagatacacaacagttaagcgtaaagatcacaggcaatagcattcaaacatggatgtgggnagagaaaggagtacctggcatgagtacctgcttagttngactgaatccttgatttttaatttggcttttcatgggccgntcacaacaccaacgctgngngaggtatggtagtcag

SEQ ID NO: 725 - DNA, 122 bp, Homo sapien
  misc_feature (1)...(122): n = A,T,C or G
atagaaagggcatacccaaaatgttactgaaaatntaatacaaattccaagattcaccaangaagtaacaaaaacctggcctgcangnggncccctatcccgtggctccatggntgatgtgg

SEQ ID NO: 726 - DNA, 477 bp, Homo sapien
  misc_feature (1)...(477): n = A,T,C or G
ctgaaccctcgtggagccattcatacaggtccctaattaaggaacaagtgattatgctacctttgcacggttagggtaccgcggccgttaaacatgtgtcactgggcaggcggtgcctctaatactggtgatgctagaggtgatgtttttggtaaacaggcggggtaagatttgccgagttccttttactttttttaacctttccttatgagcatgcctgtgttgggttgacagtgagggtaataatgacttgttggtgattgtanatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggcggctgcttttagg

SEQ ID NO: 727 - DNA, 416 bp, Homo sapien
cctgtctttgaatggatgaaataggttaataaaaaacatcactgtttaaaaactagaacactgaaaaattctaggaaagcttattttcccttatatttttatggtactttcaacacttaataacactatttcaattaagttttctcctagagtttatagtatatcagtacattcttttctgtggatgcaataatatagaatcttattccaaatcttactggcaggttctcttaaattcttcaacggctgccatagtgattaaccaaaattagttatgatttctgcctatctgtgtgagaacttacaggggaaattgttctaaacctgaggaacatgaagtaactgtactgcacactccaaatgatgacagtcattttatatcaccttcaattacccaacagcttttaatagtctgg

SEQ ID NO: 728 - DNA, 416 bp, Homo sapien
  misc_feature (1)...(416): n = A,T,C or G
cctgtctttgaatggatgaaataggttaataaaaaacatcactgtttaaaaactagaacactgaaaaattctaggaaagcttattttcccttatatttttatggtactttcaacacttaataacactatttcaattaagttttctcctagagtttatagtatatcagtacattcttttctgtggatgcaataatatagaatcttattccaaatcttactggcaggttctcttaaattcttcaacggctgccatagtgattaaccaaaattagttatgatttctgcctatctgtgtgagaacttacaggggaaattgttctaaacctgaggaacatgaagtaactgtactgcacactccaaatgatgacagtcattttatatcaccttcaattacccaacagcttttaatantctgg

SEQ ID NO: 729 - DNA, 564 bp, Homo sapien
  misc_feature (1)...(564): n = A,T,C or G
ctgtgagtagaggagtcttcccgagagtagcagttgttgatccaaatgattgaagccttcaggtaagggaataactgctgcaggaattctttcttgaagaatttaagctgtttggtaagaattctgtaactacatacctttgaaacactattcacattcaaataaacgcttgttttctagccaggcacaggctcaattagtttttcaaactctagccaaggcagtatttcatttgggaaatcatgcaacagaactgctcaattcttaacttctcctgctgttaacatttacacttagactgccagcaacagttaacttaaattttggtctcaagggaacaaaaaaaaattgcattcagaatttaatatagtattttaaaactaattttagcctgtaagncattatgagcaatagtaacttttatacctcctcatcttgnctgataatatattctatatgctgncaatctgattatatagtctatatgctagaagttgctgattttcattctgccaccaaaaaaaactgtccttttttttttatgggggaaaaagggaatttaaa

SEQ ID NO: 730 - DNA, 310 bp, Homo sapien
ccatttttatttcttcttcagagaagtgtttatttaggtctgttgcccattttacaattaggccatatgttttcttgctgttgagttgtatgtgtgtttgtataaattttgcatattaaccccttatcacacgtatgttttttaaaataaattttgcttattaatcttttatcagatgtatggtttccaaatatattcttccgatccatggattctcttttttgttatgattgtttctttgctcttcggaagctttttgttttgttttgttatttgttttactttgatatagtcccatttattgtttttg

SEQ ID NO: 731 - DNA, 467 bp, Homo sapien
  misc_feature (1)...(467): n = A,T,C or G
ngacaaccttagccaaaccatttacccaaataaagtataggcgatagaaattgaaacctggcgcaatagatatagtaccgcaagggaaagatgaaaaattataaccaagcataataaagcaaggactaacccctataccttctgcataatgaattaactagaaataactttgcaaggagagccaaagctaagacccccgaaaccagacgagctacctaagaacagctaaaagagcacacccgtctatgtagcaaaatagngggaagatttataggnagaggcgacaaacctaccgagcctggtgatagctggttgtccaagatagaatcttagntcaactttaaatttgcccacagaaccctctaaatccccttgtaaatttaactgntagnccaaagaggaacagntctttggacactaggaaaaaaccttgtagagagagtaaaaaatttaacacccatagtagg

SEQ ID NO: 732 - DNA, 492 bp, Homo sapien
  misc_feature (1)...(492): n = A,T,C or G
cctactatgggtgttaaattttttactctctctacaaggttttttcctagtgtccaaagagctgttcctctttggactaacagctaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggnttcgggggtcttagctttggctctccttgcaaagttatttctagttaattcattatgcagaaggtataggggttagnccttgctatattatgcttggntataatttttcatctttcccttgcggtactatatctattgcgccaggtttcaatttctatcgcctatactttatttgggtaaatggtttggctaaggttgtctggtagtgaggcggagngggtttggg

SEQ ID NO: 733 - DNA, 562 bp, Homo sapien
  misc_feature (1)...(562): n = A,T,C or G
ntgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccanatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgnttcctcctttagggaggcaatgcaaagagngtggacatcttctaatcttgaggaacagtngttgatttcccttgaaggagcttacatattgactgtntttcacaataacctgnttgccccagntcaatccctcattttaatacttaatgttggtnctgggct

SEQ ID NO: 734 - DNA, 265 bp, Homo sapien
  misc_feature (1)...(265): n = A,T,C or G
nggtccagaacaagagaaataactgcagaaaacacatatggttggaaaccatgcgcttgtgactttttctgtagcctatgggagtggacagagtgggtaacccaagatgtttttaagactgactggactaagaatggcgtacttatagccaactacttcccccctaatgtgactgaagggattcataatgatcacaattagcattacggttaagtattttagggttgacgtctaagctcacacttgaaaggtatttatctaatgg

SEQ ID NO: 735 - DNA, 216 bp, Homo sapien
atttaatacgtgctcactgctcggcacgcgctgaagctacagttaacaatcagtgagcacatattaaatgataaaataatgctgatggtaaacattcataacagcagagtaagattttggcagttttgtgtctcggtaacataactgtaaccttagatgaacacctatcccttcatgatctgactttagaggcaaggagtttgtaacatctaatgg

SEQ ID NO: 736 - DNA, 285 bp, Homo sapien
  misc_feature (1)...(285): n = A,T,C or G
ctgaaaggcaacntggagactagttagtctagtcccctcatattataaattggtatgctgaggccaggcagtaaattgctatggagctctccaatttaaggccagtttgactccaagggtagggcttctagtaaaattttgtgattaaattggaaactctaatttatttttctatgngtttttggtacctaatcctcataagcaagccatatttcaaggctgatcaatgaaaacaccaaataccaaagcttcctttcccttccaaatttactgaccctttgtcag

SEQ ID NO: 737 - DNA, 509 bp, Homo sapien
  misc_feature (1)...(509): n = A,T,C or G
agangaagaagangaagattaagggaaaagtacatcggtcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgngaggagctaatccctgaatatctgaacttcattagaggggtggnagactcggaggatctccctctaaacatatcccgtgagatgttgcaacaaagcaaaattttgaaagttatcangaagaatttgggtcaaaaaatgcttanaactctttactgaactggcggaagatnaagagaactncaaganattctatgagcagntctctt

SEQ ID NO: 738 - DNA, 97 bp, Homo sapien
cagtgaattgaatacgactcctatagggcgaattgggccctctagatgcatgctcgagcggccgccagtgtgatggatatctgcagaattcgccctt

SEQ ID NO: 739 - DNA, 209 bp, Homo sapien
  misc_feature (1)...(209): n = A,T,C or G
ccgncagtgtgatggatatctgcagaattcgcccttagcggcccgcccgggcagggtccttatatatagtagcttagtttgaaaaaatgtgaaggactttcgtaacggaagtaattcaagatcaagagtaattaccaacttaatgtttttgcattggactttgagttaagattattttttaaatcctgaggactagcattaattgacgg

SEQ ID NO: 740 - DNA, 164 bp, Homo sapien
ccaagctaatgggtgacactgtgaatgcaactctaatgcagcctggcgtaaatggtcctatgggcactaactttcaagttaacacaaacagaggaggtggtgtgtgggaatctggtgcagcaaactcccagagtacatcatggggaagtggaaatggcgcaaat

SEQ ID NO: 741 - DNA, 514 bp, Homo sapien
  misc_feature (1)...(514): n = A,T,C or G
ccagtcagaattgagatgtgctgtgagtgcaaaatacactcaaatctaagacttagtatggaagaaaaagaagataaggtgnttcattaataatcttttatattgattacatgttgaaatgatatttttaatatactgggttacataaactgttattaagattaattttgcttgtttcttttttaatatggctactagaaaattaaaaattatgttgtggttcacattatatttctgttgaacaatgtggacatagataatctacagtcattacattagccttagaatttagcatcatacttttaagcactctggggtactaacttgaactcccagaaacccataagcacactctgcatataaattattgcaaaattcattcttatctctctgaaagatatgcattttaagggtaaaaagaattcacaaaatattgantccttaacaaatgtcaattagtatatggagagagctaaaggacttcntgtagactggtncattggggaaaaacaga

SEQ ID NO: 742 - DNA, 439 bp, Homo sapien
  misc_feature (1)...(439): n = A,T,C or G
gcaggtcctatgcatagttaataagggntataatctactcaacatggaaaatgggagcctatttgcaaacacacgagtaattaaagtaccaattctctcttagtttctttttttatagttggnttattttgcaattataaatgntaaacatccctagagatgaaagttaaaatggctgatcacagatcagtagcaaaatacaaattgacaattcaaaattataaataaaactctgttgaggatgtttaactttgagcctccaaatttaagagctaagcttggaagaaacaaatttataggttatatttccctcttaaattaaaaaacaaacttcctctggcagtagnttgtgaattcctttcattgnaatgataccatgattacaggatcaaaaatgcttaacttacttgccattctgctcacatcatcacagttgttt

SEQ ID NO: 743 - DNA, 275 bp, Homo sapien
  misc_feature (1)...(275): n = A,T,C or G
cangacgctacttcccctatcatagaagagcttatcacctttcatgatcacgccctcatagtcattttccttatctgctccctagtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattgg

SEQ ID NO: 744 - DNA, 295 bp, Homo sapien
  misc_feature (1)...(295): n = A,T,C or G
ctgtncttttaaaaaatctggatgttttttatttagtgattgttcgacaattagctgcttcaaaacataatgtgcattgcttatgaatgccttcatatactaatacagatactctgataatattacactctaataaggataatgctgaattttgaaaggacacaaaacatctaatgccaatatatacatgattagccaacatctttgctatcaagaccactcgtttttaaataaagatgcaagtgtcagttgtagattattgggatgaagctaaatccccagaatgcagcagcag

SEQ ID NO: 745 - DNA, 477 bp, Homo sapien
  misc_feature (1)...(477): n = A,T,C or G
cgcgttactgtacatattgctagcaggagacaactggaaatactaaacaaatactggaattcacattacagacagacgaaaccaacatggatgccacacataacttcctttgtagtttcacagagagcctatttgtggttgctcaggtggggtcatacattgcttgcagaaatggcctgatcatagctctatgaaacaatgaattcggaatgaaatcttaccatgacacctctctgtaggaaagaaatgttgcttcacgtgtgctaagttgagataataatatttcacatatttatatacagagaatcactctcaaatttaacccaagataagcaataggatttgggggtgacttgtacacatttctaacaacacttttcttttttctagaggtcactctcaaacactgatatatcactatagtttgagtgtanggattcagtaatcaaaggttgttattgcaaaagagccaggcag

SEQ ID NO: 746 - DNA, 524 bp, Homo sapien
  misc_feature (1)...(524): n = A,T,C or G
ctgtgaaattgggttgggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagatataccagaagctaacattctgctgaattttatacgagaaaataaagaaacaaatgttctggatgatgaaattgacagttatttcaaagaatccataaatttaagtacaatagttgatgtctacacagntgaacaattaaagggaaaagctttgaagaatgaaggaaaagctgatccttcctatggcatcctttatgcctacatttccacactcaacattgatgatgaaactcaaaagtagttcgaaatagatgttccag

SEQ ID NO: 747 - DNA, 456 bp, Homo sapien
  misc_feature (1)...(456): n = A,T,C or G
cctcagttcttgattgtggttgacggggcgtcaccatgaaggagcccatttagtataaagcttccaaccttttctcttaatcgtttctttaatcttttaaaccatcttcaagtgcataggggagtttccgatgccagaggatgaaagcaagtgctttctccaccctctcctcccagagtgaaaacaaatccttttgctgatacttgtttcaaaagcatccattgtaaagcttctcagtgacacaaaatactgagaggtaactttttatcaatcaaaccacataccccaatttaacacctttcagtgctctgaattcaactgacagactaaagggtgtttcctgtaacagtctgaaatattaagtgttttttttgttttgtttttaaatcttatttcagaaaacttcctctnggggtaggaaagtacacatgaagcagcaaagtaacgaagaaaaac

SEQ ID NO: 748 - DNA, 474 bp, Homo sapien
  misc_feature (1)...(474): n = A,T,C or G
ccanaccagggaaccaaatgcagacagngaagttctctgcttcttttggctataatgngacaagaaagggatcatcttttgaagatgtttaaagaaataaagcaactttctttataaacagtcaaataatcaattaatggaataaataagtactaacccacattttaaccactctgtaatcactacactttacatattttttatttnggnggcaaantcccccataattagtctaaaatccaccaatcacttttaaaagtaaaatgaatagccaccaaaataagaaaatcttctgttcactctttggctaaaaaggaaaacaaataaaacaaaacaaaaagaaacagaagacaactgtaacactggtgataaaagaaactttttttttacaagtaaaataaagttatcaatttaaatcttggncactttataaaaacaagaggtaatgttgtaataaaacagcagtagcctcag

SEQ ID NO: 749 - DNA, 355 bp, Homo sapien
  misc_feature (1)...(355): n = A,T,C or G
cctgggtnnagnggctgactgnaacctccacttcctgttctcaggcaatcctcctgcctcagcctccttagtagctgggactacaggagtgtgcaaccatgcccaactaatttttgtatttttaatagagacagggtttcaccatgttgatcaggttggtctccaactcctgacctcaggtgatccacctgtcccagcctcccaaagtgctgggattacaggcatgagccaccacgcccggnccaggataaagtaaaaatttgtaagcacacaaggccctttgcaacctggctcctggttactactttaancctcctgccctcccaaatgtnctcactgtttttctanacatacc

SEQ ID NO: 750 - DNA, 493 bp, Homo sapien
  misc_feature (1)...(493): n = A,T,C or G
ccatgctggtctcgaactcctgaactcaggtgatccacccgcctcagtctcccaatagattacatatattattaatgaattgcttcctttaacaccctattcattgaattttccagtaaaccacaattactaattactcctgaaatcagaaaagaggttaaaaagattttataacagtatcctatgaaatctactactttcaagtaatagtagttgaattaccaaaacccgtcactcaagccaatgactacaattaagatatgagtaacatttcctagataaataaagtcaattaattatatttgcatctgggaaatagagaaagtacatataagccatgattttgaagncaaaagagagagantatttgccaaggaggggtgagttatagtatgtaattataacatacagaagctttttgtatgctggtaactaattttaatttcctacattnttatggagatttctgctattcttgtcctattttccacct

SEQ ID NO: 751 - DNA, 364 bp, Homo sapien
  misc_feature (1)...(364): n = A,T,C or G
cgaggtctggnaaggtcaccaagtctgcccaganagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgnggaccactttggttttcttttttgcgtgtggcagttttaagttattagtttttaaaatcagtactttttaatggaaacaacttgaccaaaaatttgtcacagaattttgagacccattaaaaaagttaaatgagataaaaaaaaaaaancntg

SEQ ID NO: 752 - DNA, 498 bp, Homo sapien
  misc_feature (1)...(498): n = A,T,C or G
ctggattatgggttggnattggtcatatgttagactccatacaggcatagctatgatgcagtgaatcccttagaagttacaattctcaaattacatacttcctcagatgtaacattagaactcaatatttctaacaataacataccagaaaaggctggactggcactcatctgctgactaacttgtagcctcagtaatatgacatacttgcctttaacaaattatctcaaattaactaacagaccttcagaaaatggagattctttttgatggggacataatcaaatttaagtctgagaaatatgcttaacagttggaactcaaattaaatgtactgattttaaagtttagacattaacaagtgatanattagcctcaaaaaaagacaatttggnaaggnttaggtcttttaatttggtgcttgntcacaacttgactggtgcttctttccttgctgcttcacatcaagcatggggccaattctattttcagtaaatg

SEQ ID NO: 753 - DNA, 467 bp, Homo sapien
  misc_feature (1)...(467): n = A,T,C or G
nacaaccttagccanaaccatttacccaaataaagggataggcgatagaaattgaaacctggcgcaatagatatagnaccgcaagggaaagatgaaaaattataaccaagcataatatagcaaggactaacccctataccttctgcataatgaattaactagaaataactttgcaaggagagccaaagctaagacccccgaaaccagacgagctatctaagaacagctaaaagagcacacccgtctatgtagcaaaatagtgggaagatttataggtagaggcgacaaacctaccgagcctggtgatagctggntgnccaagatagaatcttagntcaactttaaatttgcccacagaaccctctaaatccccttgtaaatttaactgttagtccaaagaggaacagctcttggacacnaggaaaaaaccttgcagagagagtaaaaaatttaacacccatagtagg

SEQ ID NO: 754 - DNA, 196 bp, Homo sapien
  misc_feature (1)...(196): n = A,T,C or G
gtcatgttcaagtgttntaatctgacgcaggcttatgcggaggagaatgttttcatgttacttatactaacattagttcttctatagggtgatagattggtccaattgggtgtgaggagttcagttatatgtttgggattttttaggcagtgggtgttgagcttgaacgctttcttaattggtggctgcttttagg

SEQ ID NO: 755 - DNA, 381 bp, Homo sapien
ctggaaaggattctgtacatataagacatcaaatattgagggatactggaacttttaaattaatgggcaaagaaagtcaacaaaggaagttcatatgaaatcaaactagtaatatgattacaaaaaaaaagtttaaaatttttcttggccccagtcttatcatttctgagccaaatacaattctatcgaaatcacctgaaactgaaatcaccattctaggctggttttcccataaagatggactgctccaaaaagaggaatcaagaaagaatttggctcacagtgaattattcactttgtcttagttaactaaaaataaaatctgactgttaactacagaaatcatttcaaattctgtggtgataataaagtaatgaccgc

SEQ ID NO: 756 - DNA, 341 bp, Homo sapien
  misc_feature (1)...(341): n = A,T,C or G
ggntataaacctattatttattgcagaactaataaaaaatccaaagccttgtatttgtacatctttattatctctaaagcactttcctcaacctaatttcagtttttacaattggtactcaagaaaatagagacagaaatcatttgattttgcccagaaaccatctgcttatatttataaggccacctaatttgaaatcacatatagaccaggcgcggtggctcacgcctgtaattccaacactttggaaggccaaggcaggtggatcacaaggtcaagagattgagaccatcttggccaacatggcgaaaccccgtctctaccaaaaatacaaaaatcag

SEQ ID NO: 757 - DNA, 479 bp, Homo sapien
  misc_feature (1)...(479): n = A,T,C or G
cgcnttactgtacatattgctagcagggagacaactggaaatactaaacaaatactggaattcacattacagacagacgaaaccaacatggatgccacacataacttcctttgtagtttcacagagagcctatttgtggttgctcaggtggggtcatacattgcttgcagaaatggcctgatcatagctctatgaaacaatgaattcggaatgaaatcttaccatgacacctctctgtaggaaagaaatgttgcttcacgtgtgctaagttgagataataatatttcacatatttatatacagagaatcactctcaaatttaacccaagataagcaataggatttgggggtgacttgtncacatttctaacaacacttttcttttttctagaggtcactctcaaacactgatatatcactatagnttgagngtagggattcaagtaatcaaaggttgttattgcaaaagagccaggcag

SEQ ID NO: 758 - DNA, 267 bp, Homo sapien
  misc_feature (1)...(267): n = A,T,C or G
ccatgnctaggtttatagatagttgggtgggttggtgtaaatgagtgaggcaggagtccgaggaggttagttgtggcaataaaaatgattaaggatactagtataagagatcaggttcgtcctttagtgttgtgtatggctatcatttgttttgaggttagtttgactagtcattgttgggtggtaattagtcggttgttgatgagatatttggaggtggggatcaatagagggggaaatagaatgatcagtactgcggcgggtagg

SEQ ID NO: 759 - DNA, 449 bp, Homo sapien
  misc_feature (1)...(449): n = A,T,C or G
cgaggtcttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcccgacatggagtctgatatacgttcatgggaattgtttctttctaatgttacaaaagaaattgagaaagcaaagtctcagtttgaagaacaaattaaggcaattaaaaatggttcccggctcagtgaactttctaaagngcagatttctgagctttcatttcctgcctgtaacacggttcatcccgagttactccctgagtcttcaggccacgatgg

SEQ ID NO: 760 - DNA, 414 bp, Homo sapien
  misc_feature (1)...(414): n = A,T,C or G
ccatnaactggaagcagctcactaaacaaacagnggcatacccatagaactgcatacttctcagcagtatgaaagaatgagctacttatataagcatcattgataaacctcaaaaaaaaaatgccacatgaagaancccaagggggagaaacataaaaactttatatgncagncatataaaattctagaaaatgcaaactaatccatcntaaaggaaagtaaatcancagttgtctggaggaccanagagagcaggaggagagagattnttaanggggttaaagtaaattngggagtgcccttccatttttaaatnctatgaaaatgaaagtaaaggcccntgcatgttgtaaactaatagtaacaaacagattgggttggagtggggtgttgtctggggacatcattacaaan

SEQ ID NO: 761 - DNA, 428 bp, Homo sapien
gagcctcactaaaataacagatttcagtatagccaagttcatcagaaagactcaaatggaatgatttacaagatagaacactttaaaccaggtcagtcctatctttttgtagctgaaggctatcagtcataacacaatttcgcgtacacctctgctcattatggaattacacttaaaacgaatctcaagagggtgaccattgttgtttcagataccatccctaaggagagtggttaacaggaagattgccagtgttactgatggaaagaagtgtttgtttgttttttttcttgtcaaagacttacaccatagttttaaattaaactgtcaggcattttctcagacaggttttccttttcaatgcagtaatgaagaactaagataaaaatcatgacttttgactgccactcaacattattacatgcacc

SEQ ID NO: 762 - DNA, 574 bp, Homo sapien
  misc_feature (1)...(574): n = A,T,C or G
caggtctgaactgataagtattaagagacgtttgttgctagttaagngttccagttgagagttcgaagtgaaaacctgggctctttaccagtgttgagtgagaagatttatttctctttcctctgaatttaccacatgtaacatcacagagacatgtagagttcctttaggatttgcgatttgaaccagnccagtctgattttcaggtgaattctgtgaagagcttgatgggggaagtctgaagacagaaggaattagggaaaagggtgatacttacagagtaaaggaaataaatgaaaagataatggtatttttggtagccacagggaaatagcaggaggggactggagatcacacacacgcacacgcacacacacaaacacacacacacgctaaaactcaaactaaaaacctcccaaaggagctgctttgtttgcagacttcaattngaagtagatactaagggcaagaatagaccagttaaaattcacctgaaaatctcttcccanncttcaaatgtgctaaaatatcactgtcagcttagcatctctncatgtatgtatatatagatgta

SEQ ID NO: 763 - DNA, 465 bp, Homo sapien
  misc_feature (1)...(465): n = A,T,C or G
cctactatgggtgttaaaattttttactctctctacaaggntttttcctagtgtccaaagagctgttcctctttggactaacagttaaatttacaaggggatttagagggttctgngggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggatataatttttcatctttcccttgcggtactatatctattgcgccangtttcaatttctatcgcctatactttatttgggtaaatggtttggctaaggttg

SEQ ID NO: 764 - DNA, 151 bp, Homo sapien
ctgtcaattaatgctagtcctcaggatttaaaaaataatcttaactcaaagtccaatgcaaaaacattaagttggtaattactcttgatcttgaattacttccgttacgaaagtccttcacatttttcaaactaagctactatatttaagg

SEQ ID NO: 765 - DNA, 251 bp, Homo sapien
gaagagcttatcacctttcatgatcacgccctcatagtcattttccttatctgcttcctagtcctgtatgcccttttcctaacactcacaacaaaactaactaatactaacatctcagacgctcaggaaatagtaaccgtctgaactatcctgcccgccatcatcctagtcctcatcgccctcccatccctacgcatcctttacataacagacgaggtcaacgatccctcccttaccatcaaatcaattgg

SEQ ID NO: 766 - DNA, 375 bp, Homo sapien
  misc_feature (1)...(375): n = A,T,C or G
cgaggtctgncctcctggttcttcatccattattaacagaagagcatactggtttcggtccataaaatctttgggaagggacaactgtaaaggaagttcatagtcgtcaatatgaaggattttaatttctggctttcctatcttcttcttcaggatagcttccttcagcatagaattgttttccaatataaaatattttgctgggttgtccgtactatgtaggctgaccactgggacccttggaccttcacagaataataagaaatgttgattcatgggactaaaactggcatcaaaatatgtacattgttctttcatgaaattacatgaaatgcattggcgattcaataatccttcagtagaagcactgtacag

SEQ ID NO: 767 - DNA, 485 bp, Homo sapien
  misc_feature (1)...(485): n = A,T,C or G
cgaggtctgaaccctcgtggagccattcatacaggtccctaattaaggaacaagtgattatgctaccttngcacggttagggtaccgcggcccgttaaacatgtgtcactgggcaggcggtgcctctaatactggtgatgctagaggtgatgtttttggnaaacaggcggggtaagatttgccgagttccttttactttttttaacctttccttatgagcatgcctgtgttgggttgacagtgagggtaataatgacttgttggtgattgtagatattgggctgttaattgtcagttcagtgttttaatctgacgcaggcttatgcggaggagaatgttttcatgttacttatactaacattagttcttctatagggtgatagatnggtccaattgggtgtgaggagntcacttatatgtttgggattttttaggtaagngggtgttgagcttgaacgctttcttaattgggggctgcttttang

SEQ ID NO: 768 - DNA, 379 bp, Homo sapien
  misc_feature (1)...(379): n = A,T,C or G
ctgatattctattaaagatacaaagaggagctggnaccatttcttctgaaactattacaaacaactgaaaaggtggaatttctccctaattcattttaggaggccagcattatactgataccaaaacctggcagaggtacaataataaaaggaaacttcaagtcagtatcactgatgaacaccaatgtgaaaatcctcaataaaatactggcaaactgaattcagcagcacatcaaaaagctaatccaccacaatcaagtcagcttcatccctgcgatgcaagtctggttcaacatatgcaaatcaataaatacaattcatcagataaacagagctaaagacaaaattcacatgattttctcaatagatgcagaaaagg

SEQ ID NO: 769 - DNA, 518 bp, Homo sapien
  misc_feature (1)...(518): n = A,T,C or G
cgaggtccatatgatgatcagtctatatagtttaaggcgcagatacacaaattttcaaaaatatgggtagaatatagtcaatatgaatggaatagacaatgctttgaaaatcactggagggaggctttattgtttgtgaaaacatgttgtcatcactttttgctttaagcccttggtggtgaaataactcaaaccattcttccttatgctgaagatcgagaaccccaagtatcacatctaccatcccactcatcaatgtgattggtcagtctttgctgaggncctgcatagccagttttaaagttagagttcttgcatatacatatgaaaaggcatgttacttgtgctttcaaagagctttttgcttggtgtaaaaagaaaactcaaattacagtgtgatgtggaatataatggtggtagtttcatcgagatgatgggaaagaattgataagataaagcngaaagatgagcagaattttcagattgggtntggaaagagcacttaagaaagagggtgg

SEQ ID NO: 770 - DNA, 378 bp, Homo sapien
  misc_feature (1)...(378): n = A,T,C or G
tatgggtcctgagtgtggaatataagataacaagacaattcccttgctttcaagggaaatcacactttataaaactttgaattcttgaaatgggtttcagaggttccaaggtcaaattcaagaataagagttaagaagaaaaagactatgagaaaggaagtgntgaccccatttgcatttaaatggcaggaatagtctcaatctactcattggggaaaaatgtatgttgcatatttttgagatattgcaacttgctctctctctttgccaccccaccctttgncatgctctgtttttgggctgaattggcaagaaaaatggctggagggctggaagaagntggacccttcttccttcttccttcttccttctttctcc

SEQ ID NO: 771 - DNA, 207 bp, Homo sapien
cataaatattatactagcatttaccatctcacttctaggaatactagtatatcgctcacacctcatatcctccctactatgcctagaaggaataatactatcactgttcattatagctactctcataaccctcaacacccactccctcttagccaatattgtgcctattgccatactagtctttgccgcctgcgaagcagcggtagg

SEQ ID NO: 772 - DNA, 384 bp, Homo sapien
  misc_feature (1)...(384): n = A,T,C or G
cctactatgggtgttaaattttttactctctctacaaggttttttcctagtgtccaaagagctgttcctctttggactaacagttaaatttacaaggggatttagagggttctgngggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttccc

SEQ ID NO: 773 - DNA, 182 bp, Homo sapien
cccttttcctaacactcacaacaaaactaactaatactaacatctcagacgctcagggaaatagaaaccgtctgaactatcctgcccgccatcatcctagtcctcatcgccctcccatccctacgcatcctttacataacagacgaggtcaacgatccctcccttaccatcaaatcaattgg

SEQ ID NO: 774 - DNA, 191 bp, Homo sapien
ccatggctaggtttatagatagttgggtggttgggtgtaaatgagtgaggcaggagtccgaggaggttagttgtggcaataaaaatgattaaggatactagtataagagatcaggttcgtcctttagtgttgtgtatggctatcatttgttttgaggttagtttgattagtcattgttgggtggtaattag

SEQ ID NO: 775 - DNA, 192 bp, Homo sapien
  misc_feature (1)...(192): n = A,T,C or G
ccatggctaagntatatagatagctgggtggctggagtaaatgantgaggnacgagtccgangaggttagttgaggcaataaaaatgatnaaggatactagtataagagatcangttcgtcctttacatgttgngtatggctatcatttgttttgaggctagnttgattagtcattgttgggtggtaattaa

SEQ ID NO: 776 - DNA, 144 bp, Homo sapien
ctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaa

SEQ ID NO: 777 - DNA, 483 bp, Homo sapien
  misc_feature (1)...(483): n = A,T,C or G
cctactatgggtgntaaattttttactctctctacaaggttttttcctagtgtccaaagagctgttcctctttggactaacagttaagtttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggntaagtccttgctatattatgcttggatataatttttcatctttcccttgcggtactatatctattgcgccaggtttcaatttctgccgcctatactttatttgggtaaatggtttggctaangttgctggtagaaggtggagtg

SEQ ID NO: 778 - DNA, 393 bp, Homo sapien
  misc_feature (1)...(393): n = A,T,C or G
ctgcatttttattgcgatctgcagatgaactgggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagngngtcaccataaatatcaggggcataaaaggctatctattcttaattcaaggataaaacagaagaagcttgtggnataaaacaatagtcaagatccag

SEQ ID NO: 779 - DNA, 277 bp, Homo sapien
  misc_feature (1)...(277): n = A,T,C or G
cctnttgatttgatgggtaaggggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcgtcttg

SEQ ID NO: 780 - DNA, 328 bp, Homo sapien
  misc_feature (1)...(328): n = A,T,C or G
catgntatggataaccatnttaactgtattttntgcancccgtaccttcttgggaatacaattgtctaactttttatttttggnctggctgttgtggtgtgcaaaactccgtacattgctattttgccacactgcaacaccttacagatgtggaagatgtgaaatttgtcatcaattatgactaccctaactcctcagaggattatattcatcgaattggaagaactgctcgcagtaccaaaacaggcacagcatacactttctttacacctaataacataaagcaggggagcgaccttatctctgtgcttcgggaagctaancaaac

SEQ ID NO: 781 - DNA, 305 bp, Homo sapien
  misc_feature (1)...(305): n = A,T,C or G
ctgttcagaaagctcattggacctggttttgaaaataaaacaaagttaaaaccctgggaggagttattgtgcagngtggagtactcaggctttcttataaagaaaaaaaaagttatctggtaccaaagtgtgcaacctacagaccctcaggtactgccctgtgacttctctgtatgacatcacaaggctgccaagtgcctgtttttctagaactaggagttggtgaggtttggctantgctgaaaccatgcataggattggtttactaaattaaaaccttattacgtacgtcctccaaaagacag

SEQ ID NO: 782 - DNA, 497 bp, Homo sapien
  misc_feature (1)...(497): n = A,T,C or G
cgaggtggctttaattgatgttaatgccttatgtcaaatgtaaagttagaatttgctagggctgggatagggagtgatatttctaggacttagacattgaaaactaattcagcctgtagtaacctggatggttttcaatggcatggttagtcaaattcatggttttaaacttagaagcagctttcgggggagagggtaggttggagcatttattacatattttactgtttaatgtcttaaccgtgggccttttaatttgtaaacactgaaatgattgttgggctgtggaaaacatttacctatttaccttggaagttttaaaagacagtccactttttagcatgtgtgttgcgtccagcctgtggtcgtcttaactaataaatgngatttttctctcaaaaaaaaaacctccccgggcggccgctcaagggcnaattccncacactggcggccgttactaggggatccganctcggtccaagcttggcgtaatcatg

SEQ ID NO: 783 - protein, 364 aa, Homo sapien
MWQPLFFKWLLSCCPGSSQIAAAASTQPEDDINTQRKKSQEKMREVTDSPGRPRELTIPQTSSHGANRFVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 784 - DNA, 6353 bp, Homo sapien
tggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctagaaataattttgtttaactttaagaaggagatatacatatgcagcatcaccaccatcaccactggcagcccctcttcttcaagtggctcttgtcctgttgccctgggagttctcaaattgctgcagcagcctccacccagcctgaggatgacatcaatacacagaggaagaagagtcaggaaaagatgagagaagttacagactctcctgggcgaccccgagagcttaccattcctcagacttcttcacatggtgctaacagatttgttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaatgactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 785 - DNA, 5502 bp, Homo sapien
tggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctagaaataattttgtttaactttaagaaggagatatacatatgcagcatcaccaccatcaccactggcagcccctcttcttcaagtggctcttgtcctgttgccctgggagttctcaaattgctgcagcagcctccacccagcctgaggatgacatcaatacacagaggaagaagagtcaggaaaagatgagagaagttacagactctcctgggcgaccccgagagcttaccattcctcagacttcttcacatggtgctaacagatttgtttgatgaattctgcagatatccatcacactggcggccgctcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 786 - protein, 108 aa, Homo sapiens
RRSCEPATRVPEVWILSPLLRHGGHTQTQNHTASPRSPVMESPKKKNQQLKVGILHLGSRQKKIRIQLRSQVLGREMRDMEGDLQELHQSNTGDKSGFGFRRQGEDNT

SEQ ID NO: 787 - protein, 152 aa, Homo sapiens
RPKEEVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNPQAAGD

SEQ ID NO: 788 - DNA, 1633 bp, Homo sapiens; identical to SEQ ID NO: 316

SEQ ID NO: 789 - protein, 200 aa, Homo sapien
MAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDVADYKSKGKFDGAKGPAKVARKKVEEEDEEEEEEEEEEEEEEDE

SEQ ID NO: 790 - DNA, 457 bp, Homo sapiens
ttcgcctgtgttgggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgc

SEQ ID NO: 791 - protein, 126 aa, Homo sapiens
SPVLGTRRSCEPATRVPEVWILSPLLRHGGHTQTQNHTASPRSPVMESPKKKNQQLKVGILHLGSRQKKIRIQLRSQCATWKVICKSCISQTPGINLDLGSGVKVKIIPKEEHCKMPEAGEEQPQV

SEQ ID NO: 792 - DNA, 461 bp, Homo sapiens
cggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaatgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttc

SEQ ID NO: 793 - protein, 108 aa, Homo sapiens; identical to SEQ ID NO: 786

SEQ ID NO: 794 - DNA, 970 bp, Homo sapiens
tgggctcccagagctcgggtcctttgcagcctccaccctggcgatggctccctggtcctactttctctctcaaactggctttttctcattcctttgactccgccagacttcctcgcccccatgacctggtgttgtgtctgatcaccccaacattcctggctgcccaatgtggggcaatgaagaccccagtgaaggaatgctagagtgtgtgaaagtggaggacgcatcgtcaaaggacacctgaggacgtctcaaagaagctcggcgggagagctgagcgctcggaagaaccaagaatcatctcttttgaaaaatcgattcatcaaatgaatcttcagccaacaactgttcaagaaggatgcaaatatcacagtgttagatgaactttctggttgacacctgacaggaagagcctctgtattggaccaccatgtttgtgctcactgtgtagtaacaaaccaacacaccaaaatagcgggagttgccactgacaaagagttgaatgatcaaatgacggccaaaggaggaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaaaaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaacccgcaggcagctggagat

SEQ ID NO: 795 - protein, 152 aa, Homo sapiens; identical to SEQ ID NO: 787

SEQ ID NO: 796 - DNA, 2435 bp, Homo sapiens
atccactcgggccgcatcgccgcggtgcacaacgtgccgctgagcgtgctcatccggccgctgccgtccgtgttggaccccgccaaggtgcagagcctcgtggacacgatccgggaggacccagacagcgtgccccccatcgatgtcctctggatcaaaggggcccagggaggtgactacttctactcctttgggggctgccaccgctacgcggcctaccagcaactgcagcgagagaccatccccgccaagcttgtccagtccactctctcagacctaagggtgtacctgggagcatccacaccagacttgcagtagcagcctccttggcacctgctgccaccttcaagagcccagaagacacacctggcctccagcaggctgggccatgcagaagggatagcaggggtgcattctctttgcacctggcgagagggtctgactctgggcacccctctcaccagctacaaggccttggactcactgtacagtgtgggagccccagttcccacctctgtgacaataggatcatggccttacccttgaagcattaccgagaaggagaacagagatgggcttgaagagccacgtgctgccggctccaaattcccaaggacaaggatccctctgcatttttgtctatgtaacctcttatatggactacattcagctgcaaggaaaggaaaaccttgattgcagtggtttaaacaaacagaagattgtttttccacatagcatggattctggagatgggtggctaatggtattggttcaacaactccacgaaggtaggggtcacgtcttggatccttttgccttaatctcagtgctcgttacttcatggtcccaagatggctgctgtatccccaagaatcatgtctgcgttcaaggaaggaggggtggaggaagaggaagggccaaactagctggacccgtcaccttctatcagaaagtaaaacctcgtcagaagtctgtttcctgctctctccctctgcatatcttcacttagatgcccttggcccgagccagctaccattgcacctctagctgcaaacaaagctaagacagcagggaacagaattgtcatggctgaatagaccaatcgtgttccatctactgagactggcacactgcctcctgcaataaaactgggatcccattaccaagagagaaatgcagaattgtgtaccagttagcttttgctgtgtaacaaaccatccccaaacttggcagctagaaacaaaccctgtattttcccacaatcctatgggttggcaatttgggctgggctcaacagggcagttctgctgctcacacctgggatccctcatggagctaaggtcagctgttacctcagctgggcctggatggtctaggatagccttactcacttgcctggcaggtgacaggctgttggctggaattgcttggttctcctccatgtggcctctccagcaggctagctcaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtggccatttttcacctatcacaaataattttggatgggtatttatttggataaaggtatttccctcttccccctttctctctgtctcatggggcctcactctgccaagttggaaggcactaagacattgtcctggccctcagggtctaggggaagaggtgttggggcaggaagtgagtctctccatgggctggacccactgtagtaggagtgcctccttgtctgcactgctggtatggggttaggccaggtaggacattccagaggggcttctgaaaaccaagagtccctggggaaagggaacagagtaaggcaggccttgttctcactgccctctaagggaacttggtcactcggcacttttaagcctcagtttctccagttcaataataaggacaagagcttttcccatgcattctctttccccgggaaagttgactgaggtgaccagtaatagaattgaaaagggagagtgtcttcagtgcaatgtggcatcctggattgggtcttggaacaaaaacaggacattagtgggaaaattggaaatctgaaaaaagtctgaattttagttaatataccaatttcagtcycttggttttgacagatgtaccatggtgatgtaagatgttgaccttggggtaggctgggtgaagggtatacaggaactctttgtactatctctgcaacttctctgtaaatctagtatcattccaaaataaaagtttatttaatttaaaaaaaaaaaaaaaaaaaaaaaaaaaaa

SEQ ID NO: 797 - protein, 120 aa, Homo sapiens [sequence omitted]

SEQ ID NO: 798 - protein, 164 aa, Homo sapiens
PRVRGRVGSASHGGTWRAEPESGWGPRGRGRTAAGSGEKRALPWHGPPPPAARNGMARPELRPGGGGESRGGGDDGAACRRNAGQGRRGSGGARGARAERRRAGRQHPLGPHRRGAQRAAERAHPAAAVRVGPRQGAEPRGHDPGGPRQRAPHRCPLDQRGPGR

SEQ ID NO: 799 - protein, 60 aa, Homo sapiens
HASADAWAARVMAAPGERSRSRAGDRGVEAGPRRGRGRNARCPGTGPPPRPRGMVWPGRS

SEQ ID NO: 800 - DNA, 2477 bp, Homo sapien
gccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacctactttggtctccataacttctatgttttctttccttctgacacactagtgcccctaaattgtgatttgcctatacgtttagggccggggttggaagatgttaacaaccatttaagattcatttctgcagtgggagtgggtggagtttcaccctctgggaaaggggcaggtgacaggtatttatcagtcagtgcctctctagctcttgtaggaagaagcacacgcaggatggagtctagaggatgagcgatattgactagcaattcatgggctccctccagcagtgcgagggtcagagtttctggagccttgggaggaggcatccctgtgagggggggttagggagatgggagggcaccaggaaaagtgattagaagtcaggtatgggaaggctaaataggacagagtcgagtacatctctgcttggaaaaacatatcaacacccttttttttgaacattatatcttgctcataaaagaaaactttccacattgttttaacaaaccccacagctgagagtcaggcctgaatctttgatgtgtgcccagtcacagagttgaccctattggtttgtggtggggcagggcatcaaagacatcattgactaatcacattcccctgaatagctcatatttagaaaatattcttagattctaaaaatgtactattaatttgtgatattcagtcttttaaatattttatacattaaacaggcatagttacaaatataaaacaaaaatatcccaaagccattatgcatggcactcaagattaaaatgggaaataatacatctaataaatcaaatgttccaagacttcaaaggtcttttggaaacaggctatgtaaaacagcacactggtttcaaactttggtaaattttaagaacaactcttacaaaggcatttaattcttatacataattttcaggggacctaagttaatcagctaatcatgaagacatgattttcattttagaaaacacttttgaaaacttgggataatctcatgccttaatgatcaaagcattatgagaaggacagtggtttttaacctgggcatatgttctaacacatttactctccactattcgtactctggtagccatgttaaccccatcagagattccttctcaagccatgtctcagagctgagaggcatcccagcaagttttgcagctcacagttttttccgtaaattacttattctataaaattggagtaggccataaactttggagggccctagaccaattttttggattatttttcgtcttctatcattccgctgatcttagatattctctgcattaaatattaaatatcacttctaggctgaaaaatccccctaaaaatatttctagctcagatttttcctccaaattctgcaatagaagatcacaatgtgaactctgcatctccatgttaaagtctaatggacattcacacttagcatgtctcaaagaaatctcatgtaaaccatggccatcctgttctaccttaactttctgagtctatggaatgataatttcacatctcataaacttgactgatgtaagtgtcaagaaaagattgacattttgttaaaagttagtagtgaagtgtgtaacgcttaagcaaactttcatatttcaaatctctttagcaagtgtaactcttttttcaagatgtgaaataatcattaggtcagtcatttgtaaatagtacatctgctatggactttttccagttcttcaccatccatttttataaaactcttattgttaaaaaaaaagttactcagaatttcataaagccaaacacctgatttcaggaacacttgagatgtaagaaaattttatagggacctccaatcactaattttcctattttttctctcaaagaaatgctgaagggaggaattcaggttgaatgaaaggaaatagtaacttacagccatatagagttataaagacttcttgtaaatgtgaacatatggtaaaatataaaaacatgtatttttgaaaaaaaaa

SEQ ID NO: 801 - DNA, 1619 bp, Homo sapien
ggtacgcgcccgcttgcgctccggcctctactcggcggtcatcgtctacgacgagcgcagcccgcgcgccgagagcctccgcgaggacagcaccgtgtcgctggtggtgcaggcgctgcgccgcaacgccgagcgcaccgacatctgcctgctcaaaggcggctatgagaggttttcctccgagtacccagaattctgttctaaaaccaaggccctggcagccatcccacccccggttccccccagtgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcattatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagaattaggtttgaattgctttttaaaaaaaa

SEQ ID NO: 802 - DNA, 3115 bp, Homo sapien
cgtccgcggacgcgtgggctcatcttgagaagcaggcgggttgggtgggaggaggaagaaagggaagaattaggtttgaattgcttttttaaaaaaaaagaaaagaaaaaaaaagacagcatctcactatgttgccaaggctcatctcaagctcttgggctcaagagatcctcccacctcggcctcctgagtagctgggactgcaggtgtgtgtcatcatgaccaatgtgaattgcttttgaagctggttcatgggcatgtaggccaccgaagcaattttagaccacagtaagtcaagcttttttccctccgatgatcactgggtggttgcagcattttttgcataaacctgcctaagacttgtctatcgtctgtgatcaatatgccatattacactaaggtgctcctggaaaattgggtgcagttcaaattttcctacagcaaatcatttggcaaggccagccattggggaaaccagacaactagagataaccctgaaatgaatccttttgtaaattgaagcaccatcttttctttttttgcataaattggaggttttaattttagggcagttacctgaagtgaaatataccaacaatttcttgtgttctttaaattcctagttaggtgaatatttttgaaggtcctcttttgaataaagaggggaatggacaccacatttcaggtcttctcgaagtgtggaagggcaagagagcatcagtgagctgatggtggattgcttacatcggattccattggtatgaatttcccaaactggaaatcaaagcgccagggtggggttggggctgactgctggtgagggggctggccgctggctcccgtgacgtgcgtcatgggcacgcaggcgccattttgaatctatcgtcggcacgtgggtgccattttgaatccttagttgggcctttctaaatggagaatggctttggagggagacacgttttctgtggggagggtttgggggggagggaggagggaacaagctacatgctattttgtttgtagtattgtggaacagtcttgttatggagtgccagcttagaggttgttgcaaacttgtctagaagtgagagcatggttttttttagccctttgagagtctacatctaatgaacattcttgctcacccataaataacgtcaagcctcaatgtcaccgtcacgttgggatactctttctcatctggcatcctagacaggacaaggttggttacctttccttccatgaaccatgaacctgtgacggcatcattcatcctgacttcaccaagctccgcctgtgggtgaggccagagctcccactggcaatttttagaagagccagaggctccctgcttcctctagaaataacagttcagggtgaagcatggagggtttcagttcccagacaatggaaccatttagagacaacacagttggacatttccactttttccttgattcctggaagtccagtgggttctgcagctgaaaaagccctgggtcccagcagcagagagacaggacagaggggatgcttgggcggggagggacggtaacctgcagaacagattccatttttatagaacgagtacacgtttgctaaaacagtcctgctttcccagactggattcccaccacagggacagtcggaactcaggactagctccagcgacatctttcctccgaattcaagccttctatcacaatgtcaaaacagctatttataaagccattttcattgtacttgataacagcacgagtcccaaaacttttagaaataaaataggacattggcttgattgaaaagagggactttttaaaaattgttctttcgtcagaagccttttggatgacttacaatagctctgatgaagataccaccccagcgtcagtccaataggtcagtgagtttcaacaggcatccatccctcccatgaagggattctggtgaggggaagtttctgtaatgacaggaaagcattgaccctcattgattgtcaactttggtattagccatgaaagacaggatgctcattgggtgttctgtagagtgaggaatgctgcctattccctcccagaacgtctgacccaggggtgtgtgttgaggagccctgggggaaatggaccaagttttcccacagagcagtattaggctgaagagcaggtgactggtaggccccagctcccatcattccctcccaaagccattttgttcagttgctcatccacgctggattccagagagttttccaatttgggaagccatgagaaaggtttttaaatcttgggaagatggagagagggacataggatagttgactccaacatgacaggaagaggctggagattgggaattggccatcaaccaagcctgtagtagtaaagccatggtcccgcattggaattacttggggaacttatacagttctgatacccaggctctcctagaccagttcaaccaattctaggtgggggactcaggcatcagtgtgtttcgtagctccccgggtgttttccctgtgcagccgagcttgggaaactgccatgctttttggatgtcaaggcgctgttggaggctgggtgtgacagcacagagccaggttgtcttgtggaaaccacagccacgggtttgccactggctcagcatggcctcactgccagtcccagcctggctgagggacaagatggtttctcttgggagttcctgagtggagcacccttccaggctttttgaaagccagctgatctgtggagccttgttaagggactcaatacggtgtttggatattgatgtttttccttgagactgtcttgtccatcaataaagatggaggatgtctcctctttgaaccccgcttccccaccagtactctctctcccttagagtttatgagttattcaaggaggagacttcttaaagacagcaacgcaattcttgtaacttgtgtaaatagccccatctttcagagtgataccatttctacatttgataatgcctgtattcctgtaggatgtatatagtttaggggattttttttttgtttggttttgttttttagaagtcaatatgtctggttttatttattgcttgaaaaagatcatttgaaaaaaataaa

SEQ ID NO: 803 - DNA, 1238 bp, Homo sapien
cccgggttctcttctcttcctcgcgcgcccagccgcctcggttcccggcgaccatggtgacgatggaggagctgcgggagatggactgcagtgtgctcaaaaggctgatgaaccgggacgagaatggcggcggcgcgggcggcagcggcagccacggcaccctggggctgccgagcggcggcaagtgcctgctgctggactgcagaccgttcctggcgcacagcgcgggctacatcctaggttcggtcaacgtgcgctgtaacaccatcgtgcggcggcgggctaagggctccgtgagcctggagcagatcctgcccgccgaggaggaggtacgcgcccgcttgcgctccggcctctactcggcggtcatcgtctacgacgagcgcagcccgcgcgccgagagcctccgcgaggacagcaccgtgtcgctggtggtgcaggcgctgcgccgcaacgccgagcgcaccgacatctgcctgctcaaaggcggctatgagaggttttcctccgagtacccagaattctgttctaaaaccaaggccctggcagccatcccacccccggttccccccagcgccacagagcccttggacctggactgcagctcctgtgggaccccactacacgaccaggagggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgggggagcggggcaagacccccgccacccccacctcgcagttcgtcttcagctttccggtctccgtgggcgtgcactcggcccccagcagcctgccctacctgcacagccccatcaccacctctcccagctgttag

SEQ ID NO: 804 - DNA, 4637 bp, Homo sapiens
ggtacgcgcccgcttgcgctccggcctctactcggcggtcatcgtctacgacgagcgcagcccgcgcgccgagagcctccgcgaggacagcaccgtgtcgctggtggtgcaggcgctgcgccgcaacgccgagcgcaccgacatctgcctgctcaaaggcggctatgagaggttttcctccgagtacccagaattctgttctaaaaccaaggccctggcagccatcccacccccggttccccccagtgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcattatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagaattaggtttgaattgcttttttaaaaaaaaagaaaagaaaaaaaaagacagcatctcactatgttgccaaggctcatctcaagctcttgggctcaagagatcctcccacctcggcctcctgagtagctgggactgcaggtgtgtgtcatcatgaccaatgtgaattgcttttgaagctggttcatgggcatgtaggccaccgaagcaattttagaccacagtaagtcaagcttttttccctccgatgatcactgggtggttgcagcattttttgcataaacctgcctaagacttgtctatcgtctgtgatcaatatgccatattacactaaggtgctcctggaaaattgggtgcagttcaaattttcctacagcaaatcatttggcaaggccagccattggggaaaccagacaactagagataaccctgaaatgaatccttttgtaaattgaagcaccatcttttctttttttgcataaattggaggttttaattttagggcagttacctgaagtgaaatataccaacaatttcttgtgttctttaaattcctagttaggtgaatatttttgaaggtcctcttttgaataaagaggggaatggacaccacatttcaggtcttctcgaagtgtggaagggcaagagagcatcagtgagctgatggtggattgcttacatcggattccattggtatgaatttcccaaactggaaatcaaagcgccagggtggggttggggctgactgctggtgagggggctggccgctggctcccgtgacgtgcgtcatgggcacgcaggcgccattttgaatctatcgtcggcacgtgggtgccattttgaatccttagttgggcctttctaaatggagaatggctttggagggagacacgttttctgtggggagggtttgggggggagggaggagggaacaagctacatgctattttgtttgtagtattgtggaacagtcttgttatggagtgccagcttagaggttgttgcaaacttgtctagaagtgagagcatggttttttttagccctttgagagtctacatctaatgaacattcttgctcacccataaataacgtcaagcctcaatgtcaccgtcacgttgggatactctttctcatctggcatcctagacaggacaaggttggttacctttccttccatgaaccatgaacctgtgacggcatcattcatcctgacttcaccaagctccgcctgtgggtgaggccagagctcccactggcaatttttagaagagccagaggctccctgcttcctctagaaataacagttcagggtgaagcatggagggtttcagttcccagacaatggaaccatttagagacaacacagttggacatttccactttttccttgattcctggaagtccagtgggttctgcagctgaaaaagccctgggtcccagcagcagagagacaggacagaggggatgcttgggcggggagggacggtaacctgcagaacagattccatttttatagaacgagtacacgtttgctaaaacagtcctgctttcccagactggattcccaccacagggacagtcggaactcaggactagctccagcgacatctttcctccgaattcaagccttctatcacaatgtcaaaacagctatttataaagccattttcattgtacttgataacagcacgagtcccaaaacttttagaaataaaataggacattggcttgattgaaaagagggactttttaaaaattgttctttcgtcagaagccttttggatgacttacaatagctctgatgaagataccaccccagcgtcagtccaataggtcagtgagtttcaacaggcatccatccctcccatgaagggattctggtgaggggaagtttctgtaatgacaggaaagcattgaccctcattgattgtcaactttggtattagccatgaaagacaggatgctcattgggtgttctgtagagtgaggaatgctgcctattccctcccagaacgtctgacccaggggtgtgtgttgaggagccctgggggaaatggaccaagttttcccacagagcagtattaggctgaagagcaggtgactggtaggccccagctcccatcattccctcccaaagccattttgttcagttgctcatccacgctggattccagagagttttccaatttgggaagccatgagaaaggtttttaaatcttgggaagatggagagagggacataggatagttgactccaacatgacaggaagaggctggagattgggaattggccatcaaccaagcctgtagtagtaaagccatggtcccgcattggaattacttggggaacttatacagttctgatacccaggctctcctagaccagttcaaccaattctaggtgggggactcaggcatcagtgtgtttcgtagctccccgggtgttttccctgtgcagccgagcttgggaaactgccatgctttttggatgtcaaggcgctgttggaggctgggtgtgacagcacagagccaggttgtcttgtggaaaccacagccacgggtttgccactggctcagcatggcctcactgccagtcccagcctggctgagggacaagatggtttctcttgggagttcctgagtggagcacccttccaggctttttgaaagccagctgatctgtggagccttgttaagggactcaatacggtgtttggatattgatgtttttccttgagactgtcttgtccatcaataaagatggaggatgtctcctctttgaaccccgcttccccaccagtactctctctcccttagagtttatgagttattcaaggaggagacttcttaaagacagcaacgcaattcttgtaacttgtgtaaatagccccatctttcagagtgataccatttctacatttgataatgcctgtattcctgtaggatgtatatagtttaggggattttttttttgtttggttttgttttttagaagtcaatatgtctggttttatttattgcttgaaaaagatcatttgaaaaaaataaa

SEQ ID NO: 805 - protein, 394 aa, Homo sapiens
MVTMEELREMDCSVLKRLMNRDENGGGAGGSGSHGTLGLPSGGKCLLLDCRPFLAHSAGYILGSVNVRCNTIVRRRAKGSVSLEQILPAEEEVRARLRSGLYSAVIVYDERSPRAESLREDSTVSLVVQALRRNAERTDICLLKGGYERFSSEYPEFCSKTKALAAIPPPVPPSATEPLDLDCSSCGTPLHDQEGPVEILPFLYLGSAYHAARRDMLDALGITALLNVSSDCPNHFEGHYQYKCIPVEDNHKADISSWFMEAIEYIDAVKDCRGRVLVHCQAGISRSATICLAYLMMKKRVRLEEAFEFVKQRRSIISPNFSFMGQLLQFESQVLATSCAAEAASPSGPLGERGKTPATPTSQFVFSFPVSVGVHSAPSSLPYLHSPITTSPSC

SEQ ID NO: 806 - protein, 302 aa, Homo sapiens
VRARLRSGLYSAVIVYDERSPRAESLREDSTVSLVVQALRRNAERTDICLLKGGYERFSSEYPEFCSKTKALAAIPPPVPPSATEPLDLGCSSCGTPLHDQGGPVEILPFLYLGSAYHAARRDMLDALGITALLNVSSDCPNHFEGHYQYKCIPVEDNHKADISSWFMEAIEYIDAVKDCRGRVLVHCQAGISRSATICLAYLMMKKRVRLEEAFEFVKQRRSIISPNFSFMGQLLQFESQVLATSCAAEAASPSGPLRERGKTPATPTSQFVFSFPVSVGVHSAPSSLPYLHSPITTSPSC

SEQ ID NO: 807 - DNA, 3829 bp, Homo sapiens
gtttgaaagtgtgtagcacctccaccttctctctctctctccctctccctctcctgccagccaagtgaagacatgcttacttccccttcaccttccttcatgatgtgggaagagtgctgcaacccagccctagccaacgccgcatgagagggagtgtgccgagggcttctgagaaggtttctctcacatctagaaagaagcgcttaagatgtggcagcccctcttcttcaagtggctcttgtcctgttgccctgggagttctcaaattgctgcagcagcctccacccagcctgaggatgacatcaatacacagaggaagaagagtcaggaaaagatgagagaagttacagactctcctgggcgaccccgagagcttaccattcctcagacttcttcacatggtgctaacagatttgttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacctactttggtctccataacttctatgttttctctccttctgacacactagtgcccccaaattgtgatttgcctatacgtttagggccgggattggaagatgttaacaaccatttaagattcatttctgcagtgggagtgggtggagtttcaccctctgggaaaggggcaggtgacaggtatttatcagtcagtgcctctctagctcttgtaggaagaagcacacgcaggatggagtctagaggatgagcgatattgaccagcaattcatgggctccctccagcagtgcgagggtcagagtttctggagccttgggaggaggcaaccctgtgagggggggttagggagatgggagggcaccaggaaaagtgattagaagtcaggtatgggaaggctaaataggacagagtcgagtacatctctgcttggaaaaacatatcaacaccctttttttttgatcattatatcttgttcataaaagaaaactttccacattgttttaacaaaccccacagctgagagtcaggcctgaatctttgatgtgtgcccattcacaacgttgaccctattggtttgtggtggggcaggacatcgaagatatcattgactaatcacattcccctgaatagctcatatttagaaaatattcttagattgtaaaaatgtactgttcatttgttatattcaatcttttaaatgttttatactttaaacaaggcatagttacaagtataaaacataaatatcccaaagccattatgcatggcactcaagattaaaatgggaaataatacatctaataaatcaaatgttccaagacttcaaatgtcttttggaaacaggctatgtaaaacagcacactggtttcaaactttggtaaattttaagaagaactcttacaaaggcatttaattcttatacataattttcaggggacctaagttaatcagctaatcatgaagacatgattttcgttttagaaaacacttttgaaaacttgggataatctcatgtcttaatgatcaaagcattatgagaaggacagtggttttttacctgggcacactttctaacacatttactctccactattcgtactctggtagccacgttaaccccatcagagattccttctcaagccatgtctcagagctgataggcatcccagcaagttttgcagctcacaatttttctgtaaattacttattctataaaattggaagaggccataaactttggagggccctagaccaattttttggattatttctggtctactctcattccgttgatgatcttagatattctctgcattaaatatcacctctaggctgagaaatccaccaaaaaatatttctagctcagcgttttcctccaaatcttcaatggaagatcataatgtgaactctgcatctccatgttaaagtttaatggacattcacatttagcatgtctcaaagaaatctcatgtaaaccatggccatcctgttctaccttaactttctgagtctatggaatgataatttcacatctcataaacttgactgatgtaagtgtcaagaaaagattgacattttgttaaaacttcgtagccaagtgtgtaacgcttaagcagactttcatatttcaaatctctatagcacgtgtaactcttttttcaagatgtgaaataatcattaggtcagtcatttgtaaatagtacagctgctgtgggctttttccagttcttcaccatccatttttataaaactcttattgttaaaaaaaaaaagttactcagaatttcataaagccaaacacctgatttcaggaacacttgagatgtaagaaaattttatagggacctccaatcactaattttcctattttttctctcaaagaaatgctgaagggaggaattcaggttgaatgaaaggaaatagtaacttacagccatatagagttataaagacttcttgtaaatgtgaacatatggtaaaatataaaaacatgtatttttgaaaaaatggattctactcattattttacttccatttaagatataaatgtagagaaataagtataattctaagctaatacgtacgcaatgtaggaagctgtaattactgaccaaaactatgtgaagtggagaaaacctggggaagtggatggttttagatgaaactgaagttaaattcatattgatttaaagtaaattgttataactttataaagtttttcatcatcaccacagcaatcacaaagagaataattatgaatatacgcaagaggaaatgagaagggaatccaaatgtcattaaaaaaaaa

SEQ ID NO: 808 - DNA, 781 bp, Homo sapiens
gcggcggagctgtgagccggcgactcgggtccctgaggtctggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcgacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaaaaaaaaaaa

SEQ ID NO: 809 - protein, 160 aa, Homo sapiens
MRCHAHGPSCLVTAITREEGGPRSGGAQAKLGCCWGYPSPRSTWNPDRRFWTPQTGPGEGRHERHTQTQNHTASPRSPVMESPKKKNQQLKVGILHLGSRQKKIRIQLRSQCATWKVICKSCISQTPGINLDLGSGVKVKIIPKEEHCKMPEAGEEQPQV

SEQ ID NO: 810 - DNA, 624 bp, Homo sapiens
  misc_feature (1)...(624): n=A,T,C or G
atganaaggagatgacacaaaagttagatctcatcacaagtgatttggcagattaccagcagcccctcatgatnggcaccgggacagtcacgaggaagggctccaccttccggcccatggacacggatgccgaggaggcaggggtgagcaccgatgccggcggccactatgactgcccgcagcgggccggccgccacgagtacgcgctgcccctggcgcccccggagcccgagtacgccacgcccatcgtggagcggcacgtgctgcgcgcccacacgttctctgcgcagagcggctaccgcgtcccagggccccagcccggccacaaacactccctctcctcgggcggcttctcccccgtagcgggtgtgggcgcccaggacggagactatcaaaggccacacagcgcacagcctgcggacaggggctacgaccggcccaaagctgtcagcgccctcgccaccgaaagcggacaccctgactctcagaagcccccaacgcatcccgggacaagtgacagctattctgcccccagagactgcctcacacccctcaaccagacggccatgactgcccttttgtgaacacaatgtgaaagaagcctgctgtggtactgagcgtcgg

SEQ ID NO: 811 - DNA, 572 bp, Homo sapiens
agcgggctgtgaggacgctctgggccaggctgcagcgcgagcgttccgagctgctgggctctttcgaggatgttctgatacgcgcgtcggcctgcctggaggaggcggcccgggagcgcgacggcctggagcaggcgctgcggaggcgcgagagcgagcacgagagggaggtgcgcgctctgtacgaggagacggagcagcttcgggagcagagccggcgcccgccgagtcagaacttcgcccgcggggagcggagaagccgtctggagctggagctgcagatccgcgagcaggacctggaacgcgcgggcctgcggcagcgggagttagagcagcagctgcacgcccaggctgcggagcacctggaggcacaggcccagaactcccagctgtggcgggcgcacgaggcgctgcgaacgcagctggagggggcgcaggagcagatccgcaggctggagagcgaagcacgaggccgccaggagcaaacccaacgagacgtggtcgccgtctccaggaacatgcagaaagagaaagtcagcctgctacggcaactggagctgctcagggagctg

SEQ ID NO: 812 - DNA, 594 bp, Homo sapiens
  misc_feature (1)...(594): n=A,T,C or G
cggaagttggcgcagcgcggttgccaatggtcgctccctgatttnatgccgctcgtggtgttttgcgggctgccgtacagcggcaagagccggcgtgctgaagagttgcgcgtggcgctggctgccgagggccgcgcggtgtacgtggtggacgacgcagctgtcctgggcgcagaggacccagcggtgtacggcgattctgcccgtgagaaggcattgcgtggagctctgcgagcctccgtggaacggcgcctgagtcgccacgacgtggtcatcctggactcgcttaactacatcaaaggtttccgttacgagctctactgcctggcacgggcggcgcgcaccccgctctgcctggtctactgcgtacggcccggcggcccgatcgcgggacctcaggtggcgggcgcgaacgagaaccctggccggaacgtcagtgtgagttggcggccacgcgctgaggaggacgggagagcccaggcggcgggcagcagcgtcctcagggaactgcatactgcggactctgtagtaaatggaagtgcccaggccgacgtacccaaggaactggagcgagaagaatccggggctgcggag

SEQ ID NO: 813 - DNA, 561 bp, Homo sapiens
  misc_feature (1)...(561): n=A,T,C or G
tctgacacacgagaccggttatcccatctccgcgcccctctgtgggtattacacagccactagatgaagccaaacattgttggaggtactgaaatcttagactccaccatgtgtccaggancccattgacgtcctctcttctgaaaactccgtgtggccctcgctctgcactgtcatgaggcggtgatggagctagatacccaccacggacaatgatcatcagtttggggttctctgggtctcacagggacgcacattctaggggtagcacgacactccccctgtagttgctccacacaaacgggatctctcatccaggcgatacgtctggtcctgtggcatgtggctctcnacgaaacaccagggangcattatgttggggacttcttggggctctgctggtctctgctccagacacgattaatccgaaatgtgttaantcgancacatgggtccacgtccaggacagctcccatcgaactctcnaggctctctanctcagggatgaaggaggtnaagtgatcgatnctcacaagcganagctctcgcncnatatctgcg

SEQ ID NO: 814 - DNA, 307 bp, Homo sapiens
  misc_feature (1)...(307): n=A,T,C or G
cntcgnggngttggttgtgtgggntnttctcgggtgattgggtgnnattactggacccaaccnncgtggaaanggctgggnncgcggccgntctngcagaagtatcccgatttttttttttttttttttttttttggnggagggaaanttncagacatagctttattgctgactcctgcccccttcanagccctagtcacaggcnncagggntgttttgtaanttaaantttcnggaaaatnggngtntttntgcatncaanagaagggntgccaaangnggggtattgcttctgggtggnttaccc

SEQ ID NO: 815 - DNA, 784 bp, Homo sapiens
  misc_feature (1)...(784): n=A,T,C or G
ggcacgagatataatcagactcttactcctgtacttctagaaatgatgcaaacacttcaaggacccacaaatgtggaagatatgaatgcactgttaatcaaagatgctgtgtataatgctgttggattaagctgcttatgagctctttgacagtgttgattttgatcagtggtttaaaaaccagcttcttccagaattacaagtcattcacaataggtataagccattgcgacgcagggtgatttggctcatcggtcagtggatttctgtgaaattcaagtctgacttaagacccatgctttatgaagcaatctgtaacttgcttcaagatcaagatttagtggccgtattgaaacagctacaactttgaagttaactgttgatgattttgaatttagaacagatcagtttctaccgtatttggaaaccatgttcacactactttttcagttactgcagcaagttacagaatgtgacacaaagatgcatgttttgcatgtcctttcttgtgtgatcgaaagagtcaacatgcagatacgaccatatgtgggatgtttggtacaatatttgcccctcctttggaagcagaagtgaanaacacaatatgttgagatgtgctattttgaccacacttattcatcttggtcagggattangagcagacagcaagacctgtccctttcctgctccagttattcactgagtaccagatgtttcacagccttcncatgtttatttttctggaaaatgggttaaaaatatnggtangaacctttgggaaaac

SEQ ID NO: 816 - DNA, 813 bp, Homo sapiens
  misc_feature (1)...(813): n=A,T,C or G
ggcacgagcaggctgggaagaagtccttgcttctcaaggccacgtaccggccgcgtccttccacccttgccctttaaaccacagatgccaaatgatacgccaacagacactacattccccagcagctgctgccagagccctcttgtagcttctttattttctgtttctttccagctttcctaccctcctatccccccttgtgtttgggccacaattttgaaataatttttattataggtatgtgctgccaaagccagatttttataaggtaaaataaattaagaatttaaacagtaaaagccagtgtctcaaaatgtcagcattaaaatgtgaaggggacagcagggtgtgaaccggaaacacacattgccaaacagttgccaactgaactgctgcttctcatggtccgttcttttctttgcccttaaggtcaatgccagtgtccagacgagcagtgtagaaaagctccctgtgtggtttgtcgtgaggtctgcttgtatctcttcactggcgttagtttcattagctctttattctccttacgttcgagtgaatctgccaagaacactggtggatagtattatcctaacacttttggtttgggggcggggagggggcagggaatagtgagctggctttaccaccttcaggatctcgaattgggcgcttgaacctaagaaagattgtggacttatcaaaagtcaccgctcagtgttcgtcaagcatgtatttatgtgacnatcatactagggaggggatggttgggaattcttccatgtgcaaatttngncccgcaanaagcaaaactggngt

SEQ ID NO: 817 - DNA, 229 bp, Homo sapiens
  misc_feature (1)...(229): n=A,T,C or G
gaaacttttacattaatgatttattaaaanaaacaactccttgtcccactccactgngctgcttgtaatctccatacatggcctccattttcaactgttttnttggtcacanagctccaaacanacacatttttttttccaggtaaaagctgtttttagtttgtagtacaaatgtgactgcatccaatactgacacattgttcctttggcccacagtcccantcaccac

SEQ ID NO: 818 - DNA, 781 bp, Homo sapiens
  misc_feature (1)...(781): n=A,T,C or G
ggcacgaggtgtgtgtgtgtgtgtgtgtgtaacacatgggcattggtccttccaggacaacttggttagggctccagggtggcctctcaggcaggaacaggcttttttcctcctgtcttttcctcacatcacgtcctgccccaggtcactgcataaataagtgctttggaaagtattcatctagaaagtaacataaatactgtacatagaaaagggttgccgccccttagccttcgcactgccccagagagctctccacatattgcacacggcctccccagccctgtggggtccaggcctggctgtgtctttggtagaagcttcagggacagttcctgggcagcccccacatctncaccctgctcccaaaggggagctctagggtagtcagtgggtaccagaagccttgctcggcctcgctggtggccttctaccanggatgctttcacaaggatgagacagaatcccaatggtatgcccctgcttggacactctgctcaaggtctgcatgtggcctgggaggagacaggcaggctganggcaggtggacaggtgantcctggccacanaaggcaggctcacacccttcacangaataggtggtttgngctgtcatctcggcccacggtctcctnntgcgccacccccccttnntgaatcgnaantcctcaaancccttaccaccacttgatgaccnancatttttanggcctggcttgaaggngggggccttnggccccccnaagggggaaatncccccggnngaatncccaanggggaa

SEQ ID NO: 819 - DNA, 199 bp, Homo sapiens
  misc_feature (1)...(199): n=A,T,C or G
cnnngtggaaanggctgggnnngcggccgttttcgnngtagtatcgcgnttttttttttttttttgtgggaggttntgcngtntttgnttgctctctcaaattccaggaattgacttatttaattaatgcctgcaacctgtgctagcaaatatttgnacaaaacnanttgtgttggngatgttcttttgggtcgggcag

SEQ ID NO: 820 - DNA, 211 bp, Homo sapiens
  misc_feature (1)...(211): n=A,T,C or G
nnnggcacgaggagagagagagagagagagagagagagagagagagagagagagagagagagagagagagagagagagagagagagagagagagagagagagagagagagagagagagagagacagtnctntgtgtgtctctctgtctcnaagtacncnctgaggnatctgntntctgtntntgngtacacngtatctctcntggncatat

SEQ ID NO: 821 - DNA, 952 bp, Homo sapiens
  misc_feature (1)...(952): n=A,T,C or G
nnntcaggctcctggatgagccctgcganagagggtggcagcacggagagagctgctggaggcagcagagcaccaaggaaacatccagacatgcgcggcccggcccatccgctcccggaacagcaccaagacgaaatgggaaactacatgtccccaggttcgaggctgcaggggcagactctggtgtgaacaggggggatgtgaccacctaaggaaaaggtcacacctgtcttggtatcaggggctcaagagctctcaaaaatgtaaggggccgacagtcccctgccccaggcctgatcacaactccagggtcatgaggtcagagtaaagtgcagaggtttttaaacataaccaaaatttcaggagaggccaattcttacttgaaagagcaacaccctggggcgctgcttgccattacttcctcatctttagcaacacatttgcttttcaaggtgttccttgtggaaacacacatacacatagacacatgcccctcagatgtcccctgccccctgattagtagaatgtggggtttccacaatgagcagaaactgatccaattttggttaagtttgagaagccctctgaatttgggtggttggcccaatgtaaatacttccgcagagatggagggcattcaaaacaggttctgaaaggatccagcctatcttggactttgttctggaanccanggattcagcnttggccacctgtgccaggcttgcaaggcctggtgtgaacncccaaantggcagcaaaaacaacanacagccnctgcactttggntggaccaacgtttggcctnaacaaatctngcgggttgggatnttcttgntttcncncccaggggaccnaaaacccccntacntgnaataaccntttttttttnnaaccntttanccantgggnttnccnaaaaaacttgnccccttttttttnccaanggnaaaat

SEQ ID NO: 822 - DNA, 587 bp, Homo sapiens
  misc_feature (1)...(587): n=A,T,C or G
ggcacgagaactagtctcgagttttttttttttttttttaacatttctgaattttattatttttagggaagacacgcagtttcacaagaaacaatgatttttctcaaacaatagaaaaaaaggtctttttgaaaaatccactgtcttagatgaaaagtctacccagcaagcactggggcagttctgagagtagaaaccagtgtggtggaagttacttataggaagttcagtgcagaggtctccacaagtcctgattagttctgnaaggctccattgggccagctcagggtaacagtgggaatgagctcacagacaaaggcaggcaccagttcctntgcccgggatgcaggctggctcactccccangcggntgcatcttgcttcagactcatcaaactgctgctgtccanctncgncatgactntgttgagaacatanaactctgctctctggctttgcttcanctcctggtgggcnnaattctgcttagccttctncactntgaaggntgggtctttaacttttggatttttttttccnggcagggggaaccatgaatggggtacatacccacncngggntttggc

SEQ ID NO: 823 - DNA, 264 bp, Homo sapiens
  misc_feature (1)...(264): n=A,T,C or G
ntcnatncctactangncaaactgactccgccctnagncacctngtggtccanggctgcggagctgcgatacagccttccgcgggtctgntggaaccccgacctntcntggtgtntntccntcccncnccccaacccgccaagggcctgcctttcctnctgggcctttgccagcgntnggccanaccggggccaaaccggnccccgggcacattttaaccnagggcncncttntagaanaaaaccccggntgatgttataaagg

SEQ ID NO: 824 - DNA, 520 bp, Homo sapiens
  misc_feature (1)...(520): n=A,T,C or G
tcaagcngcccccantntgatggatatctgcaaaattcnccctttcaccggccgcccgcngcatgtcttattatacaacanatccaacttccctaagnggntcacacatnntaaggtattgttaacaaaataggaaantctattngaactaacaatcatctctttgaatctgcntatcccattaaaagcattttcctcaatattcctcatatcggttatggncaatggatacccatctgagctggttganccctttaaattnattatacttaactttttgaaggctgttatacccaagggacaaacctaancaaccancagatatacttganggtntctcctgtnatttctcagattccaatataccattttgccttnacacctacagcccttaggggcatcctcnttccncanaacaaancattntcactaagacagnctggggtnntncaccaatggctaccaaacctctgnccgcnacccaccgcntaaanggcngaaattnccnanccacacgggt

SEQ ID NO: 825 - DNA, 2064 bp, Homo sapiens
cggtgcgctgagcgccggaggagcgtaggcagggcagcgctggcgccagtggcgacaggagccgcgcgaccggcaaaaatacacgggaggccgtcgccgaaaagagtccgcggtcctctctcgtaaacacactctcctccaccggcgcctccccctccgctctgcgcgccgcccggctgggcgcccgaggccgctccgactgctatgtgaccgcgaggctgcgggaggaaggggacagggaagaagaggctctcccgcgggagcccttgaggaccaagtttgcggccacttctgcaggcgtcccttcttagctctcgcccgcccctttctgcagcctaggcggcccgggttctcttctcttcctcgcgcgcccagccgcctcggttcccggcgaccatggtgacgatggaggagctgcgggagatggactgcagtgtgctcaaaaggctgatgaaccgggacgagaatggcggcggcgcgggcggcagcggcagccacggcaccctggggctgccgagcggcggcaagtgcctgctgctggactgcagaccgttcctggcgcacagcgcgggctacatcctaggttcggtcaacgtgcgctgtaacaccatcgtgcggcggcgggctaagggctccgtgagcctggagcagatcctgcccgccgaggaggaggtacgcgcccgcttgcgctccggcctctactcggcggtcatcgtctacgacgagcgcagcccgcgcgccgagagcctccgcgaggacagcaccgtgtcgctggtggtgcaggcgctgcgccgcaacgccgagcgcaccgacatctgcctgctcaaaggcggctatgagaggttttcctccgagtacccagaattctgttctaaaaccaaggccctggcagccatcccacccccggttccccccagtgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaa

SEQ ID NO: 826 - DNA, 2109 bp, Homo sapiens
tggcgccagcggcgacaggagccgcgcgaccggcaaaaatacacgggaggccgtcgccgaaaagagtccgcggtcctctctcgtaaacacactctcctccaccggcgcctccccctccgctctgcgcgccgcccggctgggcgcccgaggccgctccgactgctatgtgaccgcgaggctgcgggaggaaggggacagggaagaagaggctctcccgcgggagcccttgaggaccaagtttgcggccacttctgcaggcgtcccttcttagctctcgcctgcccctttctgcagcctaggcggcccaggttctcttctcttcctcgcgcgcccagccgcctcggttcccggcgaccatggtgacgatggaggagctgcgggagatggactgcagtgtgctcaaaaggctgatgaaccgggacgagaatggcggcggcgcgggcggcagcggcagccacggcaccctggggctgccgagcggcggcaagtgcctgctgctggactgcagaccgttcctggcgcacagcgcgggctacatcctaggttcggtcaacgtgcgctgtaacaccatcgtgcggcggcgggctaagggctccgtgagcctggagcagatcctgcccgccgaggaggaggtacgcgcccgcttgcgctccggcctctactcggcggtcatcgtctacgacgagcgcagcccgcgcgccgagagcctccgcgaggacagcaccgtgtcgctggtggtgcaggcgctgcgccgcaacgccgagcgcaccgacatctgcctgctcaaaggcggctatgagaggttttcctccgagtacccagaattctgttctaaaaccaaggccctggcagccatcccacccccggttccccccagcgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagacttt

SEQ ID NO: 827 - protein, 394 aa, Homo sapiens
MVTMEELREMDCSVLKRLMNRDENGGGAGGSGSHGTLGLPSGGKCLLLDCRPFLAHSAGYILGSVNVRCNTIVRRRAKGSVSLEQILPAEEEVRARLRSGLYSAVIVYDERSPRAESLREDSTVSLVVQALRRNAERTDICLLKGGYERFSSEYPEFCSKTKALAAIPPPVPPSATEPLDLGCSSCGTPLHDQGGPVEILPFLYLGSAYHAARRDMLDALGITALLNVSSDCPNHFEGHYQYKCIPVEDNHKADISSWFMEAIEYIDAVKDCRGRVLVHCQAGISRSATICLAYLMMKKRVRLEEAFEFVKQRRSIISPNFSFMGQLLQFESQVLATSCAAEAASPSGPLRERGKTPATPTSQFVFSFPVSVGVHSAPSSLPYLHSPITTSPSC

SEQ ID NO: 828 - DNA, 453 bp, Homo sapien
ggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagct

SEQ ID NO: 829 - DNA, 452 bp, Homo sapien
ctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtgtacgtatatgtatatgcaacacctgtgagacccccattcaggtcaaggaaaaccgttgcctgcaccccaagggccccatatttgcccctccccatcacagtcctgcccttcaccctcaagcacggtcctaaacttgtctgcactttagaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcag

SEQ ID NO: 830 - DNA, 450 bp, Homo sapien
ctgacccccctttgtccacagctaagatggcagcagaatgctatgtcactatatacagaaacaagacaacctgaagctaaatggatgccccctgcagagtcaacaggtccagcctcacagtgcacgccctgagctacagcctctcccaaaaggcatcttccccacagcctcaacgccgagcaaggagcatcaagggtttgtctcggttgttttgttctttttacaaactatagatatatacagttgaaaactcaggatttctagccaataaccatagttaccaccaccttacaaataaaaagaaaatgccagaaacatctttaaatgccttgtcacaccaacagcaaagtgcacagagtgaggagaacacgagagtgccttttcattttaaaaatgtttggaaatatgtacaactttgatacagtttcagggtgctccagacacccatgg

SEQ ID NO: 831 - DNA, 395 bp, Homo sapien
ctctaaacccctccacattcccgcggtccttcagactgcccggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccag

SEQ ID NO: 832 - DNA, 291 bp, Homo sapien
ctgactcttccatctgtgcaggttgactgaggtcattcctgagttgcagtatgttgagagggtaatatttctgtcttctctaactccccatactcccttgtcttccactctccacttaggagttttttgtgagttatgtccttgttgcttttgcctctttttctttctagccttgattgtgccagaagacaatgtccctattcacacactctttctgcttttctgtgggcaggaacatggaaggggtgctgatggacgtggactgtgagagcgtctaccccactgtgtagg

SEQ ID NO: 833 - DNA, 491 bp, Homo sapien
ctgtagcttctgtgggacttccactgctcaggcgtcaggctcaggtagctgctggccgcgtacttgttgttgctttgtttggagggtgtggtggtctccactcccgccttgacggggctgctatctgccttccaggccactgtcacggcttccgggtagaagtcacttatgagacacaccagtgtggccttgttggcttgaagctcctcagaggagggcgggaacagagtgaccgagggggcagccttgggctgacctaggacggtcagcttggtccctccgccgaagaccacattattgccgtcccacgtctgacagtaatagtcagcctcatccatagcctgggtcccgctgatggtcagagtggctgtgttcccagagttggagccagagaagcgctcagggatccctgaagaccgcttattatcttgataaatgactaccacaggggactggcctggcttctgttgataccaacaagcagatacctg

SEQ ID NO: 834 - DNA, 308 bp, Homo sapien
ctggtcgaggtccacgccgcggtaggtgaacttgcggaaggtccgcttcttcttctgctctacttctgccgtgctggagaacatcgaactgaacaagaagagtatgtattcccgtgtgccagagtgccaggtcaccacatactattatgttgggttcgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctgg

SEQ ID NO: 835 - DNA, 472 bp, Homo sapien
  misc_feature (1)...(472): n = A,T,C or G
ctgacatgttaactgtgatgcataaaactcgatcttctgatggggagtaagtgcagaaggtagaaatctccgccccgcgggggcttatctgtactggtagttcatgctgtggtctgcgtttctgccatagccgccttgtgaggactggtaggagctgggagggccactgtagttctggccggaccccggggagttgtagttcgactgtgagtagcctccttgtttgccttggtatgaggagccgcccccagaacctccgccgtagcccccgtgtgaccctgggttgtaggatgccccgcctgagccgtagctgttcccgccgcttcggcctccactaccactgtagttgaatttgctctcgtagntgtagtcggatccgcccccgcccccgggagagttgtngganttcgagtaggagtagctgccttgtccatggttatagcctttctgcttgccctgtggagggccatag

SEQ ID NO: 836 - DNA, 354 bp, Homo sapien
ccagtgcaaccttcagatagacacatggtgaccagagcccgccaggcttctgcaggtggcagtgtcgagcaagtgtaagatgtctgtgggaaggagaagctcctgaaatgaacgttctgcaaacagaaggctgaggggtcttccaggcatgtccagtcactaggagctgccaccggtgggcttgagtgccaggctctaggctttgtgcagaaagcacccggggcggggggcggtaagggagagcaaaatgggtctctctcaactgcagtcagtgctcctgggaacacggtctcacagacagcacatattctacgtcacagctctagggtttcaaggacttagccatccgacagg

SEQ ID NO: 837 - DNA, 318 bp, Homo sapien
  misc_feature (1)...(318): n = A,T,C or G
ctgaaaatgaaggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagccacattgaagcggacattggcaaccgggtccccagccatgcgcagaaccgtgggtagcatgtgcttggtggtgatgtcctgcccacagacctcagacggcacattgatgcagaagagcgtantcatgcggtgcaggtagttggggtctccggacatgg

SEQ ID NO: 838 - DNA, 277 bp, Homo sapien
ctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaaggcacgtgccatgcgccgccggctcaacaagcacgaggagaacctgaagaccaagaagcagcagcggaaggagcggctgtacccgctgcggaagtacgcggtcaagg

SEQ ID NO: 839 - DNA, 276 bp, Homo sapien
ccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagagg

SEQ ID NO: 840 - DNA, 453 bp, Homo sapien
  misc_feature (1)...(453): n = A,T,C or G
ccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactanggctcctgtaccatgtgcgtaagaatgaccgcctagccgtcaataagatgatcagcaaggtcgcac

SEQ ID NO: 841 - DNA, 142 bp, Homo sapien
agcctctctagtggcagagcagctcacactccctccgctgggaacgatggcttctgcctagtacctatccttgtgtttctgatgcagtggtagcattggttcaagttctctcctgctgtggtcagagttgcttcgatgttgg

SEQ ID NO: 842 - DNA, 83 bp, Homo sapien
cctaaaagcagccaccaattaagaaagcgttcaagctcaacacccactacctaaaaaatcccaaacatataactgaactcccc

SEQ ID NO: 843 - DNA, 482 bp, Homo sapien
ccatcggtgtctggcagatgcggcacctcaagagcttctttgaagccaagaagcttgtgtagctgtcccaggcgtcacaacccatcctcccaggctgggggagaaaggacctcctggaactgacttcttctgtcaggaggactggtttccagccatacctgttctggaagggagaggggctggaggcacccacaggcacaagctgaaggcagcagcttggctaatactgagcaggtagtggggcaaattcctgccctctctctctggcctctgggccgtttggtagtaatcacccaggggctggtaaagcccctcctcttggcacctcagaatcacagtgttactgatcagggatgtgaggctgctgttgggggtggggggaggggaatgggcaggcaagccagtcttctgtcttcctttgctaacttagggttttgagcaggttgggggtatggtgcctgtcatacccacctgccaccctg

SEQ ID NO: 844 - DNA, 534 bp, Homo sapien
  misc_feature (1)...(534): n = A,T,C or G
ccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagcggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagacttttgaacaaaggctaaaccaggccattgaacgaaatgcatttttagaaagttgaacttgatgaaaaaggaatctttgttggtctctgtacagaggttnaaggatgaagcangagatttaaggcaagaactagcagtt

SEQ ID NO: 845 - DNA, 175 bp, Homo sapien
tcgacctgtggcaaatgtggctaccctgccaagcgcaagagaaagtataactggagtgccaaggctaaaagacgaaataccaccggaactggtcggatgaggcacctaaaaattgtataccgcagattcaggcatggattccgtgaaggaacaacacctaaacccaagagggcag

SEQ ID NO: 846 - DNA, 179 bp, Homo sapien
cgcgtggacagttgcgaggggtctgtgtgaaggcacttgtcacgagcttcaatactgccgccgtcccaggatgggagaactgcgcagcaggaagggcacttctgaaagcacagtggagagatcgctggagcgggcgttctgggcaggaggaagcacagacggcaggcagggtggactgg

SEQ ID NO: 847 - DNA, 410 bp, Homo sapien
ccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccagg

SEQ ID NO: 848 - DNA, 557 bp, Homo sapien
  misc_feature (1)...(557): n = A,T,C or G
cacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaaccagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggnggacttccagcttttgattgaaagtcctagggtgattctatttctgctg

SEQ ID NO: 849 - DNA, 525 bp, Homo sapien
ctgatggtttggaaatgagagaactacagtggtgaagagaccaggaggcagctctcagtgaaaccaacattgcggatgcccttcgtgagccttctcagtcccagcaggaagcccacaacactggcctccccagcctgcctgctgacaacacctaggcttactttatctaaaatcagagtgtaccaggtctgtagcagaaaataatcaactaaatgtcagggacctatgagtcatttaaaacaaaagaggaagtgaaagccattaggcaagctatgtgctgggctgctaacgtagcccctgcagggaggggtcaggagcgcgctgcagtgagccttgggtctcgcaggcccagccctgctgcaaggagccagggcacccaggaaacatcagcacacacacacacagggaccctcccttcatgtcacttgttttgctgccctaaatggcttcttgcaccctaacccctgatcctggaagaaggcagagagactggcccgtacagagacctgcaattctacgcaagct

SEQ ID NO: 850 - DNA, 384 bp, Homo sapien
cctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcag

SEQ ID NO: 851 - DNA, 423 bp, Homo sapien
ctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaagatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtccttctgtaaggtggacttccagcttttgattgaaagtcctagggtgattctatttctgctgtgatttatctgctgaaagctcag

SEQ ID NO: 852 - DNA, 413 bp, Homo sapien
ctgaaaacagtgggaggccagatgctggcatcttccagacgggagcatagccatggtcactctagccgatgtctcctggggctctcaggcggcaaggaccagatgcaccactactgtccaatcccagttttacttagagccacctccttttttggggccattagtccttatttcatgccagattttcactagcggctccctgttcttccaaatcaattcatgaccgtaagtaacataccatattccaaaaagagctcccccaagatgtgccgcatgatcaaaaaatttccatcccaggatcattcctgctgtatccatggcgataatggctttcagggcattccctgctgtgaacgtgaacatcggaaggaaaataatggcaagcctcccttctgggatcttagtgcagacag

SEQ ID NO: 853 - DNA, 288 bp, Homo sapien
atctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggggg

SEQ ID NO: 854 - DNA, 427 bp, Homo sapien
ccaagtgagatcagccctcaagggcacatgccaagggcagagcagcccatgtagacagcttcggagggcatgggggtgtagggagttcggggtagctcctcattaactatttgttgggtgagtaaaggggtgaggctcagtggcaggtacctctgcaatgacaagctgcctcccctctatgtgtttagcatatgttattagaacgtgtccgacacccctaccgctgccatttgggccctttaataaagccaagtagagaaatctggcaataaaaggcaaatgtaagcatgctttctttaagacgcatcataaatggttttctttaagtgaatggaagagtttgacagagatacacctttgtaagaaaacattaagaatgctggctgactgtggtggctcacacctgtattcccagcactttgggagg

SEQ ID NO: 855 - DNA, 311 bp, Homo sapien
ccagtattcctggaggatataacactgacatcagcagggttttcaatggcaacaattgcacgagctgccagcagaagcttctcccaggtcctcttgagatttatgatatagatgccatcacttttccttttatagatgtactgttccatctggaagtcaagattggtgccacctaagtgggttcctgctgcaaggaacttaaggacatcctcctccttcatttgcaggacatcaagggctccggacattgtgaaagtttccctttaagttacgacgggaatccagaacaacgccgtatggacccctctgca

SEQ ID NO: 856 - DNA, 328 bp, Homo sapien
cctatggaagtttggtgctttgctccctgtgtttgcgaaacaggtatctcgtgatttcagaaaagcttgaggagattaagtctttccgggagctgacctgcctggatctttcctgttgcaagcttggagatgagcatgaacttctagaacatctcaccaatgaagccctgtctagtgtaactcagctccacctgaaggataattgtctatctgatgctggggtgcggaagatgacagcaccagttcgagtgatgaaaagaggtatccaatgcctgcatctgtgatctcagggttacatgataagtctaataatgttagattctcaagg

SEQ ID NO: 857 - DNA, 502 bp, Homo sapien
  misc_feature (1)...(502): n = A,T,C or G
ctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagangtaaggttgggctggtgctcacagacctc

SEQ ID NO: 858 - DNA, 411 bp, Homo sapien
cggccgaggtccttaatagttaagttacagctaagaatgtcatgtcttgggttggaattttcatttttagcaccgttaatgtattcacttaaatctatgttagcaccttgtctccaggcagaacaacaaaccatccaaacattttaaacattgggggaaacacgaaggggagggttaaagacagaatccagtactgtggaaggagtggatttagatcacaagatccttgtcgatatccttctgcttgatgccgaagcagccggcccactcatccagggcgatgtacttgtcattgtccaggtcacaggtctcgaaaaagcgggtggtgcaatgctccatggggatgaggggagcacgcagtggagccagctcggtgtgggagaggtacccgtcaatggggtgctggtccag

SEQ ID NO: 859 - DNA, 232 bp, Homo sapien
aaatcacagagggacttagtattccattaatgcaaatggaaacattaagttcatcatcagatgataaaaggaaaaaaaaaacctgatactcatctcaaaagacgcagagaagacatctgcataaatccagtacctattattatttcaaatttaaaaacttcttcttttttaagagatagggtatcactatgttgcccaggctgatcttgaactcttggcctcagatgatcct

SEQ ID NO: 860 - DNA, 235 bp, Homo sapien
  misc_feature (1)...(235): n = A,T,C or G
tgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaatnctttt

SEQ ID NO: 861 - DNA, 457 bp, Homo sapien
ccaaaggaaagttggaaggcaactgacagattctgccttttaggtacttgaactggcaggaaatgcatcaaaagacttaaaggtaaagcgtattacccctcgtcacttgcaacttgctattcgtggagatgaagaattggattctctcatcaaggctacaattgctggtggtggtatgttaacttctaacattttaaaaaatttcttcagaggaaggaattttttgctgcttttaattagtttttccaggagaggaaatttaagtatattttcaatgatggaagtatggttgtatcatgaaatttgatttatatgtataactcaatgaatttttacctcatacttgagctgcatgtttttaaagatacctttcaagttgaacagtatacactttcttggtttcaaatactgtgattttttaaaaaatcttaagtagaattaattcctgtcactcccc

SEQ ID NO: 862 - DNA, 561 bp, Homo sapien
ccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtatccgggcattgccgacaggatgcagaaggagatcaccgccctggcgcccagcaccatgaagatcaagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccctcgaaaagaaattgtccttgaagcttgtatctgatatcagcactggattgtagaact

SEQ ID NO: 863 - DNA, 291 bp, Homo sapien
ccatagctgtcccacctatggttttaaaaacagactgtaacttgatcttctgaaatccttctcgaaccacaactcgttctgttaaagaaatcctaggaaagaagtcctactgatattgtcgatagtctccaaaaggtgaggaaggtaactgagttgaaggcaactgggaggggtcttctgcaaactgaggaccattggaaaactgtgcagaggcaaatcttgtcaacaagataccagctccttcaattaaagctaggagaatgccacccattgcggctgacccaaccatgg

SEQ ID NO: 864 - DNA, 265 bp, Homo sapien
ctgaacttttccacctggagtccttgggaataccggacgtgatcttcttttataggtccaatgatgtgacccagtcctgcagttctgggagatcaaccaccatccgcgtcaggtgcagtccacagaaaactgtccctggaggtttgctgctgccaggaacgtgctcagatgggacctgtgatggctgcaacttccacttcctgtgggagagcgcggctgcttgcccgctctgctcagtggctgactaccatgctatcgtcagcag

SEQ ID NO: 865 - DNA, 144 bp, Homo sapien
cctccacctgcgttttgatctagatgagcatattgtccatctcccacagcttgctccggttccgcaggtacgcccgcccgtgctcgcgcgtcagcgacgcgatgtcctcgcgcatctcgttgatgaccgggagcagaaactgct

SEQ ID NO: 866 - DNA, 241 bp, Homo sapien
ctggctgtaagtagcttcatagcaccagtctttgagaatgtcaagctctccagaaatcatggcctccaggacattggggatgatgtcgttctcgcactgtttcagaaaccggtccttgtcaaaggccgggtccacccggaggatctccgtgagcacctccgacatctctgtcttggagaacaggccccccagcaagtcggtgaccttgtccgtaagggcccgggatgcccggatgaacgcg

SEQ ID NO: 867 - DNA, 364 bp, Homo sapien
cctgggcccgctgacttcagggtgaggccacagctactgcagcgctttttatttatttatttatttactgagatggagtcttgctctgtcacccaggctggagtgcagtggtgcaatctcggctcactgcaacctctgcctcctgggctgcagtgattctcctgcgttcaagtaattctcctgcctcggccttctgagtagttgggattacaggcatatgccaccacacttggctaatttttcgtatttttagtagaaatggggtttcaccatgttggcgaggctggtctcgaactcctgacctcaaggatcctcctgcctcggcctcctaaggtgctgggattgcaggtgtgagccaccacgt

SEQ ID NO: 868 - DNA, 472 bp, Homo sapien
ccaccagtccacagatgtgactggtaagggatctagtaacagaggatggagttgggcagaatattatcctggatgatatgcacccagcactaggatacacctttcattagaatgaagagaacagacaaagccctcagaaaagatacaaaggcagagacattgattagaacattatctcataacagaggtggggccattacccaccattattgtaaaataactgtaactaaccaaaacacatacaggcttctttaatggagttaataaaactatggcacattgggaatcaggggcagaggtactgttcccagacggaaaactgggataaagggagccatgctgacagggccttattccagtctaggttgttagaaaggagccctagcccagaaatgacagcaaatagccataatcattatgtggggctgaaccagaggaagccaggctgagccaagaagctggaagtatcttg

SEQ ID NO: 869 - DNA, 368 bp, Homo sapien
cctttcttgtaagtgaagaaaaaggaatgcagcaaagaagagttcgacattggagtccttagttccatcaggatcccattcgcagcctttagcatcatgtagaagcaaactgcacctatggctgagataggtgcaatgacctacaagattttgtgttttctagctgtccaggaaaagccatcttcagtcttgctgacagtcaaagagcaagtgaaaccatttccagcctaaactacataaaagcagccgaaccaatgattaaagacctctaaggctccataatcatcattaaatatgcccaaactcattgtgactttttattttatatacaggattaaaatcaacattaaatcatcttatttacatgg

SEQ ID NO: 870 - DNA, 411 bp, Homo sapien
ggcgtgtccttggacttagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcgggagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattgg

SEQ ID NO: 871 - DNA, 385 bp, Homo sapien
  misc_feature (1)...(385): n = A,T,C or G
ttttttttttttnnntttttttttttnaaagattcactttatttattcattctcctccaacattagcataattaaagccaaggaggaggagggggggtgaggtgaaanatganctggaggaccgcaataggggtaggtcccctgtggaaaaagggtcanaggccaaaggatgggagggggtcaggctggaactgaggancaggtgggggcacttntccctntaacactntcccctgttgaagctntttgtgacgggcnanctcaggccctgatgggngacttcncaggcgtanactttgtgtttctcgnantctgctttgctcancgtcagggtgctgntgaggctgtanggtgctgtccttgctgtcctgctntgngacactct

SEQ ID NO: 872 - DNA, 184 bp, Homo sapien
  misc_feature (1)...(184): n = A,T,C or G
cttccttcggtctttantatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcag

SEQ ID NO: 873 - DNA, 397 bp, Homo sapien
ctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaagg

SEQ ID NO: 874 - DNA, 156 bp, Homo sapien
ccagaagaacactatgccatggttgcactgaattttgtgcctactctagggcaaacagaattacaatcgaaggagttcctatctatctgtaaagaagagaacatgaaattctgttggcagaagcagcattttgaagaaataaaaggttcactgcag

SEQ ID NO: 875 - DNA, 512 bp, Homo sapien
  misc_feature (1)...(512): n = A,T,C or G
ccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaagtgacttgatttaagggaaaaaatgactggctatattcagtcagatatggcaaagagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttaatagattgttcagaagttttaatttatgatgggtgtggtggctcatgcctgtngtcccagc

SEQ ID NO: 876 - DNA, 199 bp, Homo sapien
cctgtgccgggccccagggctggcagccaccagctcctcttccaggcatgggggacaccctgacaggatccggaagtctccatttacccaaaaatgcaagagccatgatcagtcatggcgacactgcaggcggtactgagtgaccatgtccagtccggctccgtccctcccacacgggggacaagcttctccgaggagg

SEQ ID NO: 877 - DNA, 486 bp, Homo sapien
cgcgtgtgctgctcccttctgccaggagcccactgcttttgcacacaagctgcattttgcgcattgactcaggtcccagttgctcttcatatctccgtgaatgattggagtgcaaagatactgttctgagcgcttcccgttttctgaaagccatgtctctcaggcatgcctcgcttagttggcgatggggttggttgactgttttcgcttttttcttcttctcttttcttcttcttcttctttttttttcttttccttttctccccctcccaacgccactgacaagaaagcactaaagatgcaggttgtgcgatcaccctataacataaggaaaagaacaggagaggttaatttgaacgtgtaggctagtggtagagggagatggaggtctggggaaagagtctgtcaggtagacatctcttttaacatgtcccagtattcggttcaccagtatctctgcacctcactactacccttcactccttg

SEQ ID NO: 878 - DNA, 363 bp, Homo sapien
cctgggcccgctgacttcagggtgaggccacagctactgcagcgctttttatttatttatttactgagatggagtcttgctctgtcacccaggctggagtgcagtggtgcaatctcggctcactgcaacctctgcctcctgggctgcagtgattctcctgcgttcaagtaattctcctgcctcggccttctgagtagttgggattacaggcatatgccaccacacttggctaatttttgtatttttagtagaaatggggtttcaccatgttggcgaggctggtctcgaactcctgacctcaaggatcctcctgcctcggcctcctaaggtgctgggattgcaggtgtgagccaccacgtctgg

SEQ ID NO: 879 - DNA, 365 bp, Homo sapien
  misc_feature (1)...(365): n = A,T,C or G
gcccatgccagcgtgtggtcagcacgcacaacttgtggctgctgtccttcctgaggaggtggaatgggagcacagccatcacagacgataccctgggtggcactctcaccattacgctgcggaatctacaaccccatgatgcgggtctctaccagtgccagagcctccatggcagtgaggctgacaccctcaggaaggtcctggtggaggtgctggcagaccccctggatcaccggaatgctggagatctctggttccccggggagtctgagagcttcgaggatgcccatatggagcacagcatctccaggagcctcttggaaggagaaatccccttcccacccacttccatccttntcctcctg

SEQ ID NO: 880 - DNA, 431 bp, Homo sapien
ccatctcccctcaccccaacctggataaaatgttacactacccactaatataaccactgacacacaaaccaagctccttccagtttaacattgaacatcaatctacatttccagtgaatgagctaaacttatgagcaggccattcaacttttcatgatacatttagtgctcagaaatggttgattccattagcctgccctatagctcaggtggcccaagatggagcctatcatcttccttggggtgtttggtgtttccaagtaggagcataaaaaggataccgtcccctaccccaccaccccatcccacataccctcactggcatccaggagaccagcagcaggctcaagaccccaaatgttgggcaccacaaataatgtgatatgtgccaggagcacggggggtaggggtgaaagagaaaaacaataagg

SEQ ID NO: 881 - DNA, 335 bp, Homo sapien
ccacagaggtggtattacaaaatatacaaagtggtttctttctttacatttcatagaagaagcctgcctcatttccaaatgagagcactagaagcacaaatcatgcagaccatttactatataacttatgaaaaatgctgtacagggctgtgactatagatatagagtatttggctctgtttgggaattgatatctacaagggggagggtcaggggaggactgtctgatatcctgacttgctgggatggtggagaagctgggatgggggaggccccaatcttgctgcacggctacacccactcctcctttcctagataaggctggagcgcactgg

SEQ ID NO: 882 - DNA, 353 bp, Homo sapien
atgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcag

SEQ ID NO: 883 - DNA, 193 bp, Homo sapien
ctggcagagaagaatggctacgtgactgtcagtgagatcaaagccagtcttaaatgggagaccgagcgagcgcggcaagtgccggaacacctgctgaaggaagggttggcgtggctggacttacaggccccaggggaggcccactactggctgccagctctcctcactgacctctactcccaggagattacag

SEQ ID NO: 884 - DNA, 461 bp, Homo sapien
ctgaagaaccccatcagcgggctgttagaatatgcccagttcgctagtcaaacctgtgagttcaacatgatagagcagagtggaccaccccatgaacctcggtaagagaccacccaggaactgtacctagggttggggtcaggtgcttttgctcctgacgcagtcttggctgatttgtgagcagtgctgtttggtggcgcctatcttttcctccttcccttctgccttttagctaaattccccttgattggccctttctccagatattgagcagggaatatagaccttggaccagccagaatcttggctgaacaagggggaggttgactctgttggctgtaatgaagcttctttagaaatgattggttttggccgtacgcggtggctcatgcctgtaatcccagcactttttgaggccgaggcaggcatatcacgaggtcaggagtttgagaccagcctgg

SEQ ID NO: 885 - DNA, 266 bp, Homo sapien
  misc_feature (1)...(266): n = A,T,C or G
ctgcaatgcttcancacacttcagcaccgaggctgggcatgaggggtccgtcaccaccacatcaaatacccctaaagcaatatctttgttatgggcacttgaatggtgctgcttcacagaggctgcaccaccagtcatgaggatctcagaccagagctccaggaagttctgctgttggtctgataccaagagtaccttcagattctggaaaggattttcacggggttgccagtccagaattctttgctcctcaaggctgtacccag

SEQ ID NO: 886 - DNA, 402 bp, Homo sapien
cgcgtggtttccgattgtttgatagtatttactggagagatcatagaaacgactgtgaaccgatgtcacaccaggaaggttgttgagcatttcttcaacatcttcaattgtttcctttgtaacctgtaggtccccgatgtttaattttagagctccaattgctgttttacacaggatcactgcctcatcattacttttcaccttctcacgagtcttttccagaaaagtaagagccacattaggatcagtcatctgtctaactacatgaagaatgatttccacgagggacaaagggttcaccctgtgttcaaattcactgataaagttttcataaagcttaatgagaccatctccttgggcaaagcacggatcctgcacaaaatcaagcacctgaagtgtcag

SEQ ID NO: 887 - DNA, 342 bp, Homo sapien
ccaaagcgagagcattggcagtgaattgcagacactcttccttggtcatgccttcccggtaggtagcatcaacatagccatagatgtaggagctcccggagcctccaatggcaaaggactgccttaccatcataccccccataggcactgagtacacctgccctccttcttgagggtcccagcctgcgatgatgattcccgccatcaggtcttcccggtatcggtaacacatctccttaaagaggctggctgctgtgtggaccagtggaggctcattcagttcaatgctgtggaaaccgagctggtaggtgacagcatcagctactgcctgggtatcagcag

SEQ ID NO: 888 - DNA, 228 bp, Homo sapien
cgcgtcggccaaggctgctgctgttgctcctccaaagaaggttggcttcaaggccgtgtccagggacccacgagcagaggcactggggggcaagggatctccaagggggcaagggatccctaaagggggtagctcacaggtgagggggtttagggcccctctagggagcgcctgaggccatacattcaagagtgtccctggtgaggcccagggaagagccaggactgg

SEQ ID NO: 889 - DNA, 378 bp, Homo sapien
ttggcttttctccccttctcatcctcctctcccctttcctcactgaaggctgtgagttgctttcaatgtgacaacactatgatgtcatttggaaggatttgccaggacagactgattctgagtcctgggtgccgtatgtgtatgcggcagtgttgtcaggcgatcttgtttgaagctctatgttgccataattaccatcaagtacacactgttggcaaaaggctaacacctgactttaggaaatgctgatttgagaacaaaaggaaaggtcttttttcactgcttaaagtggggtcactttgatacctttgcggtcatgtctgtgtctgatgagtgtagaatctctggatgtgcactgtcagtcatgtgtccaccagg

SEQ ID NO: 890 - DNA, 215 bp, Homo sapien
ccattttggagtgtgtccattgggtagcaatgtggaaaccaccagggcctttgtggagaaaatggagggggttgagggagtcccaggaggggcttatttgagggcctttgccacttgctcataggcgagctcgatctcctcatcatctggacaggtggaagcgaattcttcccgggcgtaggcattgctcaagtaccgatgcactccccggaagg

SEQ ID NO: 891 - DNA, 412 bp, Homo sapien
ctggtcaagttcaacagagccttggctgaccattctatggctcaggcacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaagg

SEQ ID NO: 892 - DNA, 472 bp, Homo sapien
  misc_feature (1)...(472): n = A,T,C or G
ttttttttttttttttttttttaattactaccttttattctaatgtgaaccatggccctgaaagctgataacaagcttggctgancagagggaactaggggtcggcagaaaggattatgggtggaaaacattggctcttccttggggagtgatgctggggaaagggaananagtggctcancctgcaggtaaataggctanaaaagccaaggccaaaggctggaggggagaggacagtcagcatgtccagcctggggtctgggtgtagggttatcccttctccctgtgccttcccatctcgtccatgagcctaggtcttggagccttgtgttggaggctgctgtgatgtcaggaacggggatctgtctagcttttggccacttcctgggacctcacgcccctgttgacagatggagattgggcagcagggccttgctgcgttgttatctgctgttccgacttggtttgtctt

SEQ ID NO: 893 - DNA, 477 bp, Homo sapien
  misc_feature (1)...(477): n = A,T,C or G
caaagattcactttatttattcattctcctccaacattagcataattaaagccaaggaggaggaggggggtgaggtgaaagatgagctggaggaccgcaataggggtaggtcccctgtggaaaaagggtcagaggccaaaggatgggagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctgtcctgctctgtgacactctcctgggagttacccgattggagggcgttatccaccttccactgtactttggcctctctgggatagaagttattcagcangcacacaacanangcagtttccagatttcaactgctcatca

SEQ ID NO: 894 - DNA, 289 bp, Homo sapien
ctgtcttatggctatgatgagaaatcaaccggaggaatttccgtgcctggccccatgggtccctctggtcctcgtggtctccctggcccccctggtgcacctggtccccaaggcttccaaggtccccctggtgagcctggcgagcctggagcttcaggtcccatgggtccccgaggtcccccaggtccccctggaaagaatggagatgatggggaagctggaaaacctggtcgtcctggtgagcgtgggcctcctgggcctcagagtgctcgaggattgcccggaacag

SEQ ID NO: 895 - DNA, 179 bp, Homo sapien
  misc_feature (1)...(179): n = A,T,C or G
ctggatgggtccanacaaagtggaatccctggaacctttaactgagcagtgaaggtcagtgcctcagagcctgagagatgaacaggaccagagagagaggtgggcaggcaggcacaaggttatgtcttcctcagactcggaaccctgctcttctccaccatccagacgttcagctacag

SEQ ID NO: 896 - DNA, 557 bp, Homo sapien
  misc_feature (1)...(557): n = A,T,C or G
ccactcactgctgggacccaggcacctcccttctccatcctctctggattgtcagtaatgtcctggaacagaagcctgtgggatggccttgggcacggagaagccctggggtcagtgtcgtgcacggatggcggcagtgttgaacccaggaggctgaacccggcccaccacggaagatgagtgcatggcaaccgcctgccttcacgtcgctccacttggtaaccccaaggtctgggctgttctaggtattgcttcacgtgccccagcaagcccttaacaagagggcctggttccctgaagaaccaatcccaggaaggggccttgatccctccgccttgctgagagtgaaccctcgtctctcctcacnctccatttcatttctgggaattggggcttagtttcgaacctttggcaaggctgttcttactaatgcccaagcccctttacccctctccctataggttacacaggggagaccagggcctcggcagaagactgctgccacacttccgaatcattctgcttgccaaataggtcatcttcaccagttgactgac

SEQ ID NO: 897 - DNA, 495 bp, Homo sapien
ctggaatctcctttgcaatcccatctgataagattaaaaagttcctcacggagtcccatgaccgacaggccaaaggaagagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttt

SEQ ID NO: 898 - DNA, 406 bp, Homo sapien
ccacgactgcatgcccgcgcccgccaggtgatacctccgccggtgacccaggggctctgcgacacagggagtctgcatgtctaagtgctagacatgctcagctttgtggatacgcggactttgttgctgcttgcagtaaccttatgcctagcaacatgccaatctttacaagaggaaaccgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgacggaaaaggagttggacttggccccggaccaatgggcttaatgggacctagaggcccacctggtgcag

SEQ ID NO: 899 - DNA, 277 bp, Homo sapien
cctaagagtcattaaaaaattctccctttgtaacctcagtgctggggactgaggcgagccccctcaggtcgctggagtgcaccagtcttggggaagaggtgcaggagaagctgtgttttttatctccacacgcagtatgaagataaaattacatagtattacctagacatagacagtattacctaggtagatgcactgctcacctgcacccttcccagctctcatttttgttaggtgatttgggatagggatagtgttttggggtatggggggagtg

SEQ ID NO: 900 - DNA, 389 bp, Homo sapien
ctgttttgaaatatttactgttattaaaacttgcttcaagggaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtctttatccatca

SEQ ID NO: 901 - DNA, 453 bp, Homo sapien
ctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcag

SEQ ID NO: 902 - DNA, 293 bp, Homo sapien
cctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccattggcctctacatgcccgctgtcggcttcttgctcctggtccttggtctcaaggctctggaactgtggatgcag

SEQ ID NO: 903 - DNA, 228 bp, Homo sapien
ctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcag

SEQ ID NO: 904 - DNA, 388 bp, Homo sapien
ccaagcgctcagatcggcaaggggcaccagtcttgatctgcccagtgcacagccccacaaccaggtcagcgatgaaggtatcttcagtctcccccgaacgatgaggcaccatgacgccccaaccattggcctgggccagcttgcacgcctgaagagactcggtcacggagccaatctggttgactttgagcaggaggcagttgcaggacttctcgttcacggccttggcgatcctctttgggttggtcactgtgagatcatcccccactacctggattcctgcactggctgtgaacttctgccaagctccccagtcatcctggtcaaagggatcttcgatagacaccactgggtagtccttgatgaaggacttgtacaggtcagccag

SEQ ID NO: 905 - DNA, 272 bp, Homo sapien
  misc_feature (1)...(272): n = A,T,C or G
ccggagcccacggnggtcatggctgccagagcgctctgcatgctggggctggtcctggccttgctgtcctccagctctgctgaggagtacgtgggcctgtctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccag

SEQ ID NO: 906 - DNA, 525 bp, Homo sapien
ctgtgcacccgagtgtcctttcccccctaagctggcacataggagcaaaagttcactaaccctgcagtggaaggcaccaattgacaacggttcaaaaatcaccaactaccttttagagtgggatgagggaaaagaaatagtggtttcagacagtgcttcttcgggagccagaagcactgcaagttgacaaagctttgtccggcaatggggtacacattcaggctggccgctcgaaacgacattggtaccagtggttatagccaagaggtggtgtgctacacattaggaaatatccctcagatgccttctgcaccaaggctggttcgagctggcatcacatgggtcacgttgcagtggagtaagccagaaggctgttcacccgaggaagtgatcacctacaccttggaaattcaggaggatgaaaatgataaccttttccacccaaaatacactggagaggatttaacctgtactgtgaaaaatctcaaaagaagcacacagtataaattcaggctgactgcttct

SEQ ID NO: 907 - DNA, 365 bp, Homo sapien
gtaaattttaagtctttcagttttatagatacggaaaacaagggtgactctttaccacaggatgaataaagaactaagtaatatgggaaatgcagcaatttctggactagctgagccgattccttcctgtgagcacactgtaagctttcaagttctctgggcaggaattacagcacctgtcccctgcaatggccctgctgtgtgatgctcatcgcttcccttcgtgctggagcagtcccccaggtgtccatctcctatctttttgttccaatcttctgtgagttccagctagcaggctttacatctggggaaaggaaaaccaggggttttagctctgttctctgctcccatccttcgctcaccag

SEQ ID NO: 908 - DNA, 608 bp, Homo sapien
  misc_feature (1)...(608): n = A,T,C or G
cggaggtgcctcagccatggcatggatccctctcttcctcggcgtccttgcttactgcacaggacgtgcggcctcctttgaggtgacccagccaccttcaatgtccgtgtccccaggacagacagccaagatcacctgcactggagataggttgggggatgaatatgtttgctggtatcaacagaagccaggccagtcccctgtattgataatatatttggataacaagcggccctcggggatccctgaccgattctctgcctacgcctctgggaacacagccactctgatcatcagcggggcccaagttatggatgaggcttattattactgtcaggcgtgggacggcagaactgtggtgttcggcgaagggaccaacctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggncagcagctatctga

SEQ ID NO: 909 - DNA, 513 bp, Homo sapien
ctggtctcaaactcctcacctcaactgatccgcccaccttggcctcccaaagtgctgggattataggtgtgagccaccgtgcccaaagttaagtatttttgatcaagtgttttgtcttttgtgcaaggcatttgtggctctgtcatagcagaggaaaacaaaacatgcctatcaaatgaatcaagtccgacctcttctcatattgagcaactagaggtctaggaacatttcccctacctgtcattctcatctggcataccaggtgtacatactccttcttattctcctctgttaccaagatgttggccccattgggtttgaggtcacgaactccacaaactccaaactcttggacctcagtgctgaaggtgaggtcatagcctagtgtggagacatcattttccagcagataaaccagaccttggtagaagtggtaatcttcactctccatatctgtatatctgactgacttgcccaagatgtgtttgtaaaaggatcgagtaaagtagcact

SEQ ID NO: 910 - DNA, 272 bp, Homo sapien
ccggagcccacggtggtcatggctgccagagcgctctgtatgctggggctggtcctggccttgctgtcctccagctctgctgaggagtacgtgggcctgtctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccag

SEQ ID NO: 911 - DNA, 263 bp, Homo sapien
cctgcaggtacaaattgaccaggctgttgacggctgcctccacgtcggtggaataattctgacgaatctgggagctcatggttggttggcaagaaggagctaaccacaaaaacggtgctggcaggtcccagaagcaggagatggccgagaagatggtcccggaggttgcaagcggagaggaaatcggagggcggtcggaggctggaagagagtccccggatctgttccgtccaaacactgttgaagcaagagacagacccgcg

SEQ ID NO: 912 - DNA, 470 bp, Homo sapien
ctgtgagcaccagcccaaccctacctctttaaaaagaaaaaacacaagtccactctgaagtcagcctctgtaacctccccacaagaaaaccgttttacatcagtcactaaccaaacaaccaacagtgcttcaacacagaaagtaaagcattatccagggcttggactgtctttcaagaaagccccaaatcccctggcaggaggaagtcacagcagtgaagccccatcccaggcccagttgttcccacgaaacacaccacgtggagacccagcatgactgccgactgattccaagtccccaggagggctttattttttcttttcaacatcctgttctgcggcttccttggcactttttgcccgtatgccgaagagccgggcgttggcacgggccatacggagactagcgaaggctttgaaattcttctcttcctcagtgatgactcgagctttctccttcttatagacgtt

SEQ ID NO: 913 - DNA, 426 bp, Homo sapien
cctggacaccataaggctggtgggctttcagaattgtgttaggggggcaggagtggcaggttcctgaatctcggtcaatatagtaaccagcaggacaagaggtgcaggaggagcccacatcagaggcttctagggcacagggacggcagtaggaggccacgccattcataacattggtgacattgatggagtagatcttggcaacgtcattggtgtacttcctgcttgcctcatgaaaagtggtcctctggaaggcccaggtgaggctcgtggtagtgttctcctcaatgatgtaggtataggactgtttgcctttggaacctttccacgtctccacaggagtgttggtcctagaattcacacccaccatgaagtagagctcacagttcacagaacagagggtctcaaagacaaatgtgattctgg

SEQ ID NO: 914 - DNA, 252 bp, Homo sapien
ccaagctgggggtgcgcacatgtggaagaactggaggcccggtgtcatgagcagaggctgtaccctagatgcccgccccagtgccagccaacccaagacaggagaaagagtttggcagtttcgcctctgaggaatacatgcctggccctcctgtgaggtgaggcggtaggggggaaggcgcaggctccgaagtctgagggcttgccggagggggagtttctgagccttttgcatgggtgcatgccccctgcc

SEQ ID NO: 915 - DNA, 234 bp, Homo sapien
ccactgggactttggcttcctgatgccgattgtggatttctgctgcaaagacagtgatgttgagccaggctgtttcctctctatccagaggttttgtagttttaataaaaccatcctctggattaatagtgaaaaatctgtcgaggtcagtgtgacgatcgatggaataccttatcgggctgttggcagcatcagggtctttggcatgcactctcccaaccacggtgccagcag

SEQ ID NO: 916 - DNA, 366 bp, Homo sapien
  misc_feature (1)...(366): n = A,T,C or G
ccattcagtctcanttcagaaaattccagaagaagaaggctgggtctcagtcctagtgggagaaccccctcctagtccacctgaaaacaccaaattcaaccatcatctgtcaagaaattaaaagaacaacaccctagagagaagtcatccacacacaatccacacacgcatagcaaacctccaatgcatgtacagaaacctgtgatatttatacccttgtaggaaggtatagacaatggaattgtgagtagcttaatctctatgtttctctccattttcattcctcctgcaactattttccttgatgttgtaataaaatgaagttacgatgagtgatnaaaaaaaaaaaaaaaaaaaaaaaaaaaa

SEQ ID NO: 917 - DNA, 492 bp, Homo sapien
ggcacagcgagggcagcatctggaggagctctgcagcctccacacctaccacgacctcccagggctgagctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggtcttccagcttttgattgaaagtcctagggtgattctatttctgctgtgatttatctgctgaaagctcag

SEQ ID NO: 918 - DNA, 557 bp, Homo sapien
  misc_feature (1)...(557): n = A,T,C or G
ctgctcctgggtaggcgtgcgggccatatcgtaggggtaggatactagccgctcgccgccgttcagatttgctcccagcacgaaggggttcttctccatccaggcaatgatggcccggacctccgtggataccgtggcatctggcgaaaggtagcgttcagggatgggcaagttattgttggggacccggtaggggacccatttcctctcctcagctccccagagcacagagttgagatccgggaaatcttcaaagatgtcaaagccctcctcagtccacagtcccagcgcccagttcccaaactctgagcccatctgcgctgccacctcgtagccatcagggttcagtgagggcaccaggtggatgcgtgtgtcctgcaccaggctgcgcacacgtgggttcccatcgcggtactctcggcacaggtactgcatgagcagcagcaacagctctcggcccagcacctcgttgccatggatcccagcagtgtagcggaactcgggctcccccagttcatgctccccanggttgtctgagatctccatggcatagatct

SEQ ID NO: 919 - DNA, 407 bp, Homo sapien
ccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcatcacagaaatagcaaagttcttgaaagtctcccaggggcagttggttgtaatgcagcctgagagattccagtctaagtatgagccccggagccacatgatggacgtccagggctccacccaggactcggccatcaaggacttcgtgctgaagtacgccctgcccctggttgg

SEQ ID NO: 920 - DNA, 340 bp, Homo sapien
  misc_feature (1)...(340): n = A,T,C or G
cctcttgggcagcnnagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtagaaaactgtgggaaactgtggctaataaaaactaagtgtgagcgtcnaaaaaaaaaaaaannaaaaanaaaaaaagcttgtac

SEQ ID NO: 921 - DNA, 571 bp, Homo sapien
ggaaaaataattttattcctcaaatgatcagcacattcagaagcaggacagaggagctctgatgacatctctgggggactcaaagcggccctcattttctggtattttcccaggtgattctcttccaacctgtgagtcctgctctctttcctcccatctgaagtttgagacatcctctgccacaaggaaagccaccaataccagcccaaagagccaccagagaggaaccaaaccacatgcatcaagttataggaaggatgcaagaagggaaattaggaaggaaagggaggagtttagttggcattctggggcatgctaacatgagggcgatggtctctctccaagtcgctggacatatcccttttctttccaggtgctccaactccaattgcagtttgggggaacgtgtgaaacttgttgaagtcctgcgtgtatgtgcccagcatgcaagtactcagattaccgcaccgcttagatctggggctgtccaggctggagccctctctctcttgctcctgctccagctcactggccttcatctgcacatagtcctgcaccagtgcagccagca

SEQ ID NO: 922 - DNA, 262 bp, Homo sapien
  misc_feature (1)...(262): n = A,T,C or G
gcccaanacatncaggtcacagcagattcgggcacgtgtggaagaaggttggatgatgtcatccacaaaccctcgcactgctgcagggaaagggttggcaaacttctcgatgtactctgcctgancagcttccacattctcatgccctttgaagatgatctccacagcgccctttgctcccatgactgcaatctctgnggtgggccangcatanttggtatcaccacaaangtgcttagagctcatgacatcntaggcacct

SEQ ID NO: 923 - DNA, 234 bp, Homo sapien; identical to SEQ ID NO: 915

SEQ ID NO: 924 - DNA, 152 bp, Homo sapien
ccaggattgacaggccatccattcacagccaggagatgctgggccagttcctccaagaggtctccgtcatggcagtgatgaaaacctaacagggtggccccctgtgccagctcaggtgactggagcccgagggcctgacaggttcccagcag

SEQ ID NO: 925 - DNA, 400 bp, Homo sapien
caatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattgg

SEQ ID NO: 926 - DNA, 521 bp, Homo sapien
ccacgtccctattttagaaatgagaggagtgactgcacacaggaaaaatgccacttttagcaattcaaagtggaaaaacttcttttatataaaaattatcccaactcccaccccttggctctcagtgttgcatctcccacagaggtaaagttgtgccattttcccacggctttaaacaaagcaaaacaaaaccaccaatcctaataacccccctccctgccccgtctccacgctgtgcggagagggctctagcccctcagtcggacttctccttctccttcatgtgcaagaagacgatgctgaagatgaagagccccagcatcatggagaaggcgctggcgtagtaggggtaggccgaggggatgaagcgctcatactgcgtgtgctggagtggccgcacggatacctgagtggaagagtacaggtgtgtgtagcctagccggttgtaatccactttaaactggaatacaccatacacgtcgggcaacttgaactgaacactgtatttgccacctttcttc

SEQ ID NO: 927 - DNA, 520 bp, Homo sapien
ccaggctagtctcgaactcctgacctcaggtgatctgcctgcctcggcctcccaaagtgctgggattaccggcgtgagccaccatgcctggccttacattttttaaaatgagggaacaaatgaataaatgaccaccatgttaggggctggctctgaacagaattgtaaagtgggccaagcttgctctcaaggtcaccttaagcccacggttgctgtgtcctgccctctcagggtcatttcccagcctccaggcacctgttcacagaggctgcatctggcctcgcctccacccctccatcctaaggtgctccgctgacttagaacaggacagtcagggagagaatgtgtctcaggagggtggagtcagatgatcacggccttcctggcatctgaggggatacagcttcgggtagcaaagtgtgattttccctgagccccaggaaagcttggccttggtcagaatacattgaaccctgagggccagagagtccctggggcaagctctgagagggaggacctc

SEQ ID NO: 928 - DNA, 492 bp, Homo sapien
ctgagctttcagcagataaatcacagcagaaatagaatcaccctaggactttcaatcaaaagctggaagtccaccttacagaaagacaaaaagaaacccctttttatatcttaacaaagcaatagctctcaagcagcagagcatctcgaggaagaaagcttgcccggtcgccatcccatcatgccagagcgtgcagtgtccacccttgactacgctggggaattgctgattttttgaaaaagcttaacttaacaatttctgatgtctatcttttagagttctgtatgttcccattttttattcttctgaattttgaattgcaagtagctgtaaaatccaatctctgagtgcatgggggtgggtgtgaggcggggctcagcttcaaccccctgtcctgtaaagcagtggctggtttttcctgagcccagccctgggaggtcgtggtaggtgtggaggctgcagagctcctccagatgctgccctcgctgtgcc

SEQ ID NO: 929 - DNA, 209 bp, Homo sapien
ttttttcaccatctaacaaaggcactttattgcattaccattcacaattaacagtcaagaacaaataataataacaaataaaataacttttaagaggacaaggcattagaaataaaaaaggacactaataacatttgtaaaagcttgtactggatgtggttgcccccatttgtgtgtgtggttgtgtgtgtgtggttgtgtgttggtgg

SEQ ID NO: 930 - DNA, 617 bp, Homo sapien
cgcgtcctttaacaagccccgttctcaaaaggctgggggtatttatataagaacttattccaaagtgactctaagatccatgttcccaagatctagtacgggctattcatggttctgaggcatgtccagcatgcaggcaaacttatctgttcaaattgaggtaaaacagacaaaaaacacttaatattaacagaagctacataattaaaactaaccttctgctgcttatttaagctaatgatgtattcttaccaaacagagaccctcaagtcaatcatttcttttgattttagttaccacccccaaattaagcctcttctttcaaagccattattagttaaaaaaaagttttaaaatgaagaaaaatattttttccagaacttgtattttgtaattagtgtgatgcaatttctttttatttttcaaacttagaaataactcatgtatggtactatttggtatttttttcagataccaaggaataccgacaggattcataaataggattttctgacactggcaggaaagtctgctaacgtttacaaaataccaaagactcttctttcaagcttcaaagatggctgagaattaacagttatgattagtttttcagtaca

SEQ ID NO: 931 - DNA, 521 bp, Homo sapien
ccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttt

SEQ ID NO: 932 - DNA, 197 bp, Homo sapien
ccttgtgaccaattacatatgattaaaattacttcccacattcacatccacagtactcgtccaccatttaacatctcaaccaaaacgttacacatgtgaaacaatcactaacaggcaaaaatactaaacctgtatatttggtattgcaaatacacttatgcatgagcaagcaagggattcacagtgagaatctacag

SEQ ID NO: 933 - DNA, 610 bp, Homo sapien
cctcattttaacaatatcttttttttgctcttctgcttccaaaccttatttgccaatgtaatgcctttatataaagttcttatgatgaatgaaaaactttcaagtgctgttgcctcattaaatgcattatttattaatttaacttctagtactctcgataaagagccagtgaaatgagttattgagttccagggaaaaaaatgagaacataattttgaatttattatctctctatacacacacagttcataattggattacatataataataatatcaacaagtctatcagtatcgaagttggatactggtaatttctcatgtgaggctcttgtgtcacagtcagcatagatttctggagcatttgtctgttgatcttttggtggcctcaaacctcattaagtggtgtgggagatgctgtttctgccatgtgagaatgtgatggcagaattaacacaaccccaccaggggtacaacagagcactttacatccaaaggcagagagggacacagcaatgcagaattccagcacacttaagaggagcaccatgccatccagacccattaagatggacatagtcccatgacaattatttgagttgccatagtag

SEQ ID NO: 934 - DNA, 384 bp, Homo sapien
ctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctctgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccaggcag

SEQ ID NO: 935 - DNA, 125 bp, Homo sapien
  misc_feature (1)...(125): n = A,T,C or G
nttaaaattcatggaagtaatannacagtaataaaatatggatactatgaaaactgacacacagaaaaacataaccataaaatattgttccaggatacagatattaattaagagtgacttcgtta

SEQ ID NO: 936 - DNA, 546 bp, Homo sapien
  misc_feature (1)...(546): n = A,T,C or G
gcccatgccagcgtgtggtcagcacgcacaacttgtggctgctgtccttcctgaggaggtggaatgggagcacagccatcacagacgataccctgggtggcactctcaccattacgctgcggaatctacaaccccatgatgcgggtctctaccagtgccagagcctccatggcagtgaggctgacaccctcaggaaggtcctggtggaggtgctggcaggttctcccgccaaggttctccccctgcctcgaggaggaaggggctggaggctcatggctctgcctcccatagaccccctggatcaccgggatgctggagatctctggttccccggggagtctgagagcttcgaggatgcccatgtggagcacagcatctccaggagcctcttggaaggagaaatccccttcccacccacttccatccttctcctcctggcctgcatctttctcatcaagattctagcagccagcgccctctgggctgcagcctggcatggacagaagccagggacacatncacccagtgaactggactgtggacctc

SEQ ID NO: 937 - DNA, 550 bp, Homo sapien
caccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcaccca

SEQ ID NO: 938 - DNA, 192 bp, Homo sapien
  misc_feature (1)...(192): n = A,T,C or G
tttttttttttttttttttttttttttnggaaaaagcccaaaaggcactttattggaggtctntgcctccattcacaggaaaaaggagctgggagccccatcctaagggtcccagcatcagcccactggagggcctggaacagtccancactntgtgggaaaggagtggggaggggaatgttttaaaaaaaa

SEQ ID NO: 939 - DNA, 337 bp, Homo sapien
ccaaaatattggaacacacagaaccaaaccaggtgtgttctacacctgcatgagtgaaggatttccacgtagacacctaggaagagcccgcatgccctagactcactccagaggaaggattgatttgcaaccagaaagggagctgaaaaccacggagctccatggctcttcattcaaaagggaaaataatgattccacgttgctttttagagttcaaatcaacatctttctggataaatctattttttaacaatctttttattatttgtaaaagatataaaaacaactcccatcagtagcaatacaaggttatacattttaaccagattttctcagg

SEQ ID NO: 940 - DNA, 362 bp, Homo sapien
cctgtccaaacgtgcgcaccaggaccgaggggagctccctcccaacacctgctaggaattgccaacttttaaatggatggggttttttatgggttgaacctctgttaatacttttgtacactctcactacagtttatatttttataggctattttctcaaggtgtttctagattccacatatctattttatataacaagttattatgttatgtgtgtgactcccttgtgtgtatctgtgccagcctcagcctccgagttgcttttccctctggccctgactctcactgactcaccgatgtggtgtgcaggcccacttcttaccccagatagcctcgggcgctgcctgtagtcatgccgacag

SEQ ID NO: 941 - DNA, 216 bp, Homo sapien
ctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcatgtcgcccgctgagctgagtgg

SEQ ID NO: 942 - DNA, 324 bp, Homo sapien
ctgattggcttcaggccccctacctctataaactctaccagcattactacttcctggaaggtcaaattgccatcctatatgtctgtggccttgcctctacagtcctctttggcctagtggcctcctcccttgtggattggctgggtcgcaagaattcttgtgtcctcttctccctgacttactcactatgctacttaaccaaactctctcaagactactttgtgctgctagtggggcgagcacttggtgggctgtccacagccctgctcttctcagccttcgaggccagggagcctcaaatcttcagtctctcagagaccacag

SEQ ID NO: 943 - DNA, 597 bp, Homo sapien
ctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaaagagcatgatcctgtaggtcaaatggtgaat

SEQ ID NO: 944 - DNA, 359 bp, Homo sapien
ctggaagaggaaaaggagatactgcagaaagaactctctcaacttcaagctgcacaggagaagcagaaaacaggtactgttatggataccaaggtcgatgaattaacaactgagatcaaagaactgaaagaaactcttgaagaaaaaaccaaggaggcagatgaatacttggataagtactgttccttgcttataagccatgaaaagttagagaaagctaaagagatgttagagacacaagtggcccatctgtgttcacagcaatctaaacaagattcccgagggtctcctttgctaggtccagttgttccaggaccatctccaatcccttctgttactgaaaagaggttatcatctgg

SEQ ID NO: 945 - DNA, 367 bp, Homo sapien
caggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgggaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtgg

SEQ ID NO: 946 - DNA, 335 bp, Homo sapien
ccacagaggtggtattacaaaatatacaaagtggtttctttctttacatttcatagaagaagcctgcctcatttccaaatgagagcactagaagcacaaatcatgcagaccatttactatataacttatgaaaaatgctgtacagggctgtgactatagatatagagtatttggctctgtttgggaattgatatctacaagggggagggtcaggggaggactgtccgatatcctgacttgctgggatggtggagaagctgggatgggggaggccccaatcttgctgcacggctacacccactcctcctttcctagacaaggctggagcgcactgg

SEQ ID NO: 947 - DNA, 384 bp, Homo sapien; identical to SEQ ID NO: 850

SEQ ID NO: 948 - DNA, 173 bp, Homo sapien
ctgtggaggggacactgtctttgaggcatcactggttccacaaagggtaggggaaggtcttgagggaccaccccatgccctcattaatcaaccagaagcttggcctggagcagcagcggggattccagtagctgtgggcatacaggatgctagggcggccacaacccaggcag

SEQ ID NO: 949 - DNA, 211 bp, Homo sapien
  misc_feature (1)...(211): n = A,T,C or G
ccatccacgttgnnaaacagaataaaatggaaattcaccttgtcatctacccgacattggccttcctgtgccacggcatcatgggctgcctgtatggcctcattcttttcaaagcattttgctctgtcttcaggggacattttctctgtttcagaaagaaactgtttcagaactgatccatcctcaaatcccagtttgtcttgattattgg

SEQ ID NO: 950 - DNA, 382 bp, Homo sapien
cctcatcgtgagtcaggacgtggtgaaagctgcagtggctgctgtgctctctccagaagaattcatggtcctgttggactctgtgcttcctgagagtgcccatcggctgaagtcaagcatcgggctgatcaatgaaaaggctgcagataagctgggatctacccagatcgtgaagatcctaactcaggacactcccgagttttttatagaccaaggccatgccaaggtggcccaactgatcgtgctggaagtgtttccctccagtgaagccctccgccctttgttcaccctgggcatcgaagccagctcggaagctcagttttacaccaaaggtgaccaacttatactcaacttgaataacatcagctctgatcggatccag

SEQ ID NO: 951 - DNA, 473 bp, Homo sapien
  misc_feature (1)...(473): n = A,T,C or G
cctctctgccaggcaaaggagggagctgcggctctttgacattaaaccagagcagcagagatacagccttttcctccctctccatgaactctggaaacagtacatcagggacctgtgcagtgggctcaagccagacacgcagccacagatgattcaggccaagctcttaaaggcagatcttcacggggctattatttcagtgacaaaatccaaatgcccctcttatgtgggtattacaggaatccttctacaggaaacaaagcacattttcaaaattatcaccaaagaagaccgcctgaaagttatccccaagctaaactgcgtgttcactgtggaaaccgatggctttatttcctacatttacgggagcaaattccagcttcggtcaagtgaacggtctgcgaagaagttcaaagcgaanggaacgattgacctgtgaattctttgccgtctaangcagttgtttatgacag

SEQ ID NO: 952 - DNA, 312 bp, Homo sapien
ctgatgggtctcatagtcctctgggatggtgtcattgcagcggtaacgcaggttggcccagatgatgttctcctgggagaagcagaagacccccaagcggccaccccgcatggttgtgtccaagaccacgttgctgtcggccaccagctcagggccctcatagaatcgcaccctgatgtagcccacttggggccggtgctgcaggaaccaacgataggacttcttgtccttccaacccacgtttcgcgggtccttccacagcagccgcacctgagactctgtgtctcctgtatgccacagagcgttccgcag

SEQ ID NO: 953 - DNA, 397 bp, Homo sapien
cgcgtccactgccgaccctcttggtttctgaaaccaacctttcttcctgctctcctctttaagagcaaaccccaacatgtataaggtcacagcaagtggtagccaggaaaagctgtgggacccctcatttgagtcacatccatatggcatggagaaagaaaacctctctgccagaaggaactgaactctggaagtcctaaggaaggtcaccatgatcagcagataggaaagcattgccaagggctgtccctcaagagcttagttttcttagggagaccagaaagacatcagatcctgactgccctgttttgctcaagttctgaaatgagtggcatgatgaagagctggtggagctgagggaaagagtcaaccatgtggggtggggtagtgaggaagg

SEQ ID NO: 954 - DNA, 304 bp, Homo sapien
cctttgtaccgggccagcaactggaagggcacagtgtggaattccagggcctgcagagtcttcttctggaacagggcctcgtggctccagtacagggacaggttgaactgcagctcaaagagctcctcagggagcatcatggggaagcggatcttctccaccaagccctccacctcctcatgggaggcacgctccccccagctccaggtgtccacggccttcagtagggccagctcgctgggcaccgccaggtcgctcctgggcagcagcagttggagcaggtctgtggggacactgggccagg

SEQ ID NO: 955 - DNA, 156 bp, Homo sapien
ctgtttcaactccctgccaagaaaaatgtagatgcaattctggaggagtatgcaaattgcaagaaatcgcagggaaatgttgataataaggaatatgcggtcaatgaagttgtggcaggaataaaagaatatttcaatgtgatgttgggcactcag

SEQ ID NO: 956 - DNA, 543 bp, Homo sapien
ctttcatctgaccatccatatccaatgttctcatttaaacattacccagcatcattgtttataaccagaaactctggtccttctgtctggtggcacttagagtcttttgtgccataatgcagcagtatggagggaggattttatggagaaatggggatagtcttcatgaccacaaataaataaaggaaaactaagctgcattgtgggttctgaaaaggttattatacttcttaacaattctttttttcagggacttttctagctgtatgactgttacttgaccttctttgaaaagcattcccaaaatgctctattttagatagattaacattaaccaacataattttttttagatcgagtcagcataaatttctaagtcagcctctagtcgtggttcatctctttcacctgcattttatttggtgtttgtctgaagaaaggaaagaggaaagcaaatacgaattgtactatttgtaccaaatctttgggattcattggcaaataatttcagtgtggtgtattattaaatagaaaaaaaaaatt

SEQ ID NO: 957 - DNA, 528 bp, Homo sapien
ctgtgatcaagatgtattaaaagaatatgaaagagcatctgggttattctagaagttctgtgatcaaaacatattaaaaaaaattaaagcgcatctgggttattctagaagttcctgggctttatacttggatatttacagaggaagttgaacttcaagttctgccactcttcaaaatgggtgacaggagaggacgtgataggacagttaaaaaaaaattgatagtcattctctgatggagtgaagcaagctttgtcaaccatcaacaaatatgacttcattggtcacaagccctgcagagatccaacaagatttgagttttaaatacagaacatatttcaaacagaaccagcagagtgctgatgtatgaatggaattgattgctgaaggcagagagtataaagaatctcaagaaacttttagtgccattttcatttaataagccattggtatagcaacctaaaaaccttggctgtgatgacaccaggatgtgtttatggaattgctgcaggagaacacaattggcag

SEQ ID NO: 958 - DNA, 451 bp, Homo sapien
ctgtctgaccatggggaccttctgtctgaagaggagctggatgaatgagactctgggaatcatctacacaggaccaaacccaacaggcgccctggcaccggggaggcgggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaagtagcatcgagagtggagttcagctcctttctctacttttttttggtctgatggcacatatttattgttctgtggtctaatcacagtgtttctaaatgtaaaaagtgcatatgttggtgtagctagtcccgcgacattgagctcctctgcatgaagacactgggctcctgcatccag

SEQ ID NO: 959 - DNA, 158 bp, Homo sapien
ccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccag

SEQ ID NO: 960 - DNA, 235 bp, Homo sapien
ctgagcagggaatccggccggaggaaggagcagcttaccgactgcgggtgttcaccacaggccaggccctaatatgcacccactagtttagctcagactcctctctacatatgaatggcaaaggcacttttgatatacactgtaaaatacactgtattttagaatcggaatctattttctaatgttcccctcaagggctgagtggcaggaaggttgaggatgcaggactttgcag

SEQ ID NO: 961 - DNA, 375 bp, Homo sapien
cctggaaagaaaagggatatgtccagcgacttggagagagaccatcgccctcatgttagcatgccccagaatgccaactaaactcctccctttccttcctaatttcccttcttgcatccttcctataacttgatgcatgtggtttggttcctctctggtggctctttgggctggtattggtggctttccttgtggcagaggatgtctcaaacttcagatgggaggaaagagagcaggactcacaggttggaagagaatcacctgggaaaataccagaaaatgagggccgctttgagtcccccagagatgtcatcagagctcctctgtcctgcttctgaatgtgctgatcatttgaggaataaaattatttttccc

SEQ ID NO: 962 - DNA, 409 bp, Homo sapien
  misc_feature (1)...(409): n = A,T,C or G
ctggggaggccccncgggcctctcangtggacaggtccaggcattggttgaagctggatgaagctggggcctnngctcctnctcatcaaatacagatcactgngaccctgtcctcctccatggtgctggtctcctcggccccactgcccctgcttctgctttcttcctccacctcctcctcccccagctccatgtccagctcgttgcctgcctctgagggtgtgtaggtggagccactgatggaacggcagctaaagaagacgattcgcttgagccgcttgttgtagaagaagtagttgaaggaccagaggctaccatcctccccgaagggatctgagtccaagtctgggttatagctgtagatgtcacattcagccaggcagatctcctcgtccaccgcgttccacag

SEQ ID NO: 963 - DNA, 163 bp, Homo sapien
gccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccag

SEQ ID NO: 964 - DNA, 344 bp, Homo sapien
ccactggctgagttattggcctggcaggtatagagtccgctgttcttctcagtgatgttggagataaagagctcttgtgtgtgttgctggatgttcccatcaatcagccaagaatactgtgcaggtgggttagaggctgcatggcaggagaggctgaggttcacccctggacggtaataggtgtatgagggggaaatggtggggtcgtctgggccatagaggacattcaggatgactgggtcgctgtggtcaacacttaattcgttctggattccacactcatagggtcctacatcattccttgtgacactgagtagagtgagggtcctgttgtcattggacag

SEQ ID NO: 965 - DNA, 461 bp, Homo sapien
ctgagctttcagcagataaatcacagcagaaatagaatcaccctaggactttcaatcaaaagctggaagtccaccttacagaaagacaaaaagaaacccctttttatatcttaacaaagcaatagctctcaagcagcagagcatctcgaggaaggaagcttgcccggtcgccatcccatcatgccagagcgtgcagtgtccacccttgactacgctggggaattgctgattttttgaaaaagcttaacttaacaatttctgatgtctatcttttagagttctgtatgttcccattttttattcttctgaattttgaattgcaagtagctgtaaaatccaatctttgagtgcatgggggtgggtgtgaggcggggctcagcttcaaccccctgtcctgtaaagcagtggctggtttttcctgagcccagccctgggaggtcgtggtaggtgtggaggctgca

SEQ ID NO: 966 - DNA, 246 bp, Homo sapien
cctttcacagacactaccattgagtgggttgatgcaggttgcagccttcagtccccgagtactgggttctgataaaattccacagaatccagcatcactgggctcagacggcatccactgtagtaaactatttgtaaatggggacatatcttcccagcaccagtaggacacattgatcttccgaaggccgacccatggggttaaggtgagcttggacatgctctgagatgactgcattattcgcag

SEQ ID NO: 967 - DNA, 244 bp, Homo sapien
ctggagcattggcagggacagtcagaaaggagacaagtgaaaacggtcagatggacacaggcggaggagaaaagacagagggagagagaccatcgggaacaatcagaggggccgagacgatcagaaaagggtcagcccgagacaggctgagccagagtttctagaagcagtttccaattcaacggctcgctttgagggccaacgtgtcctaggccgaggctgcagaagcgctcacacactcacg

SEQ ID NO: 968 - DNA, 436 bp, Homo sapien
ccaaagtctttaccctatttaaccccttgtatatttctgactgctcactgttcatattataggggaccagatttgtaatatagaattctccataacatgaatgaaattaatgctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtacgtgtgtattttaatatagcctgacctgaatttatatgtttttagctttagtatttaactttttgtaacaaataaaccttttttaaaacaagtttaaaaaagaaaaa

SEQ ID NO: 969 - DNA, 383 bp, Homo sapien
ctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcgaattagccccaaattgaacgctgaatcgtgtcccatgagatcaggcgccatctgtaaagtctcctctggaaatgccaatccatccttcccccag

SEQ ID NO: 970 - DNA, 543 bp, Homo sapien
ctgtagcttttgtgggacttccactgctcaggcgtcaggctcaggtagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctaggacggtcagcctggtccctccgccgaacaccgaagtgctactgtttgtatatgagctgcagtaataatcagcctcgtcctcagcctggagcccagagatggtcagggaggccgtgttgccagacttggagccagagaagcgattagaaacccctgagggccgatcagtgacatcataaatcatgagtttgggggctttgcctgggtgctgttggtaccaggagacatagttataaaaaccaacgtcactgctggttccagtgcaggagatggtgatcgactgt

SEQ ID NO: 971 - DNA, 416 bp, Homo sapien
ccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcaccactgtactccagcctgggcaacagcgagactccatctcaaaaaaaaaggaaatgtgtatcaagaacatgattatccaggggtattttctaattcagatcatcaaactgattatatagaagagttggctttaaaatgtttgca

SEQ ID NO: 972 - DNA, 242 bp, Homo sapien
ccaaaaatcccaaaacatcattttcaatcagtagagaagtgcttagggttgaaaattgatttcatttgctactgaatttggtaaatcctgggtaacttttatcaagatgaagacattttaccctacctactctagaaatatacaacaatgttatattttacactccttggaaacatttgaggaaaaaaatgcaatttgcacttcactttgttggaatatcccatagcactcaataaactcag

SEQ ID NO: 973 - DNA, 347 bp, Homo sapien
cctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcaggacattttcttcccacagatagaaaaggagggagttacactcaggctgcaagcagtgacagtgcccagggctctgatgtgtctctcacagcttgtaaagtgtgagacag

SEQ ID NO: 974 - DNA, 571 bp, Homo sapien
gaaagagcgagatgcgagaacacttttggctaaaaatctcccttacaaagtcactcaggatgaattgaaagaagtgtttgaagatgctgcggagatcagattagtcagcaaggatgggaaaagtaaagggattgcttatattgaatttaagacagaagctgatgcagagaaaacctttgaagaaaagcagggaacagagatcgatgggcgatctatttccctgtactatactggagagaaaggtcaaaatcaagactatagaggtggaaagaatagcacttggagtggtgaatcaaaaactctggttttaagcaacctctcctacagtgcaacagaagaaactcttcaggaagtatttgagaaagcaacttttatcaaagtaccccagaaccaaaatggcaaatctaaagggtatgcatttatagagtttgcttcattcgaagacgctaaagaagctttaaattcctgtaataaaagggaaattgagggcagagcaatcaggctggagttgcaaggacccaggggatcacctaatgccagaagccagccatccaaaactctgtttgtcaaa

SEQ ID NO: 975 - DNA, 221 bp, Homo sapien
  misc_feature (1)...(221): n = A,T,C or G
ctggaggtgcctcanaaggtgcattctgcttcctgcaggggcttgaaacaccaaggcactccagggatcctggagtcaaagcagcagccccggttgttgcactccttgggggtgacatgggggtagccgcagtccaccctgtccttggctggcacggcacactggtttgcagacaggcccacgtactcctcagcagagctggaggacagcaaggccaggac

SEQ ID NO: 976 - DNA, 316 bp, Homo sapien
ccatcagattgtcacagacttttataaccctttgatccctaccaacgttaagtatgagtttggccctgccatcttcattggctgggcagggtctgccctagtcatcctgggaggtgcactgctctcctgttcctgtcctgggaatgagagcaaggctgggtaccgtgcaccccgctcttaccctaagtccaactcttccaaggagtatgtgtgacctgggatctccttgccccagcctgacaggctatgggagtgtctagatgcctgaaagggcctggggctgagctcagcctgtgggcagggtgccggacaaagg

SEQ ID NO: 977 - DNA, 335 bp, Homo sapien
cctgtttgtctgtacagcaatgcagatgcgcaggcccatcctggtggaggacccagatgcagggagcaaatattcgggttgtgttgctaagagtcgcaggaactactgctagtgatactaggcttgctgcaggaggatgtcacgctgagaaagggagatgactaggagcagaaaaagtactctcactgttccagcttccagcccaatcctagcagaatgaatgcattttaaaatcagtccacattcacatgtgctgagaaggttgttagtggtccctcatctgggcaaagcagacccaagatggtgctaagtgcagagtgcagagcattcttgtg

SEQ ID NO: 978 - DNA, 280 bp, Homo sapien
cctaacacccaagctcttccttgcagaagagctgagatgctaaggagaccatctggagtgtcataataagcccttgggatttgctgagctcccacatggctttcttcaaccacctggcccactttcttcaaccacattccactttggaatgcgtgtctttaaggcaccaagtgatcttaagaatgggctctgtttttgaattcagcaatccaagttcctatctatctcggtgggacctccaaaaaaaagaaaaaggattggcttggcttctaatgtaagg

SEQ ID NO: 979 - DNA, 318 bp, Homo sapien
ctgtccagatgacagtaagattccactgtctgtaatcctcatggtgccaggtctcctggggcatctagggcaatgatgctactgcagtttatgcagttacacagtcaagtctgtgccaaaggaggtcccatccggcggccaggtttctgttcagtctggggagcaatgccaactggctgcccccatagcctggcatgagctgatggcccagtgcaatcccaaagcaaagaagggcagaactgggccaagaagctgtggtaatttgctctccctgcctccgacagcgtcgtcctctccttttgcagccccacacgcagg

SEQ ID NO: 980 - DNA, 568 bp, Homo sapien
ccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatgggagaaccaggaagatgtggtcattcattcaatagtgtgtgtagtattggtgctgtgtccaaattagaagctaactgaggtagcttgcagcatctcttctagttgaaatggtgaactgataggaaaaca

SEQ ID NO: 981 - DNA, 550 bp, Homo sapien
ccatccccctttagaacgtatcttaatgtgaacataaattgttcttcatgatgcttaaaagcttacatataattttcattcttagaaaaacgccacattttggatcctggatttttctgaatatcatgattgaaaaaaacaaaacaaaaaatgaacccaaatcaaagtgtggttaaacttatatgagaaagatttttcaaccagatggtcattcaaaaaagttggagctgtaagtgccggcgactgaggacacagggttaattcctcgctgctggtggaaggctagagaacatcttcaaaagagggtagcaagacgtgctcctaggggaggctcagtgtggtctcgtctgcccaagcattttcagtcttgcttggtcaatgacatcgagtaagtttttggcatccacagccagggcgtgagcagcagtcagcatttgctttttgtactcttgctggaggctggtcatgacatactgctgggccagtttcatcttgttgatgagctcacccaggtcagagttcaatagcttctgtgccatctcaatctctc

SEQ ID NO: 982 - DNA, 524 bp, Homo sapien
ccaaggtcagaggctgatgcaacaggccctcttctccccagggccaggctcctgtccagcctgggcactgcccagagtgatggcattggtccggatgctgttctgtctctgcttggacaccttcgcaaagatttctttcaggacagtctcaaaggctagctcaacattggtagagtccagggctgaggtctccaggaagagcagtccattgttttcagcgaacattcgggcctcctcagtgggcacttcccgggcctggctgaggtcacttttgttacccacgagcatgacgacgatcgtggcttcagcatggtcatagagctccttcagccatcgctccaccacagcataggtctggtgcttggttaggtcaaacaccaggagggcccccactgcaccacgatagtacccttgaagacaaagttataatcttcctcagttccattccccatcttggctccgcatggagggtgcaggtgtcttcggggacagaggcgacaaatctgtgtgttggctcaatgccc

SEQ ID NO: 983 - DNA, 140 bp, Homo sapien
ccttcgtgccctaacagccagtcccctgttaaagtggaagagacctgtggctgccgctggacctgcccctgtgtgtgcacaggcagctccactcggcacatcgtgacctttgatgggcagaatttcaagctgactggcag

SEQ ID NO: 984 - DNA, 358 bp, Homo sapien
tggagcggccgcccggcaggtccaacgagtcacaacagtgcaataggtagaggattaaaaactgcatcaaacaggtgctgaaaataaatactacctaggagaaggaggtgagagccctcgtgtggggtttgttttcgaccccttgagtgtgtgtggggtttgtcttccgagccacgagcctggcctgtctcgcggtgctgttcactctgacagagtgcgcctgcagcacgttgcctccagggcccagcctcccagaagcctcagagcatcagagcatccgtcccatcggatggaccagaaacaagaaaatggggtggggtgaatcacagctatcattcaaaggaaaggaatttttttc

SEQ ID NO: 985 - DNA, 450 bp, Homo sapien; identical to SEQ ID NO: 830

SEQ ID NO: 986 - DNA, 340 bp, Homo sapien
cctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatatccagttttatttatttatttttaatttgtttttttctccaagtccaccagtctctgaaattagaacagtaggcggtatgagataatcagg

SEQ ID NO: 987 - DNA, 227 bp, Homo sapien
ccaatgcccggagcaggccctctttccatcccgtgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatgg

SEQ ID NO: 988 - DNA, 241 bp, Homo sapien
cctctttttaccagctccgaggtgattttcatattgaattgcaaattcgaagaagcagcttcaaacctgccggggcttctcccgccttttttcccggcggcgggagaagtagattgaagccagttgattagggtgcttagctgttaactaagtgtttgtgggtttaagtcccattggtctagtaagggcttagcttaattaaagtggctgatttgcgttcagttgatgcagagtgggtttt

SEQ ID NO: 989 - DNA, 193 bp, Homo sapien
ccagccgtgtcccagacttgtagtttgatcttcttcccctctatatccacagtgcggatcttgaaatcaattccgatggtggagatgtaagtgttgttgaagttgtcctctgcaaagcgaatgatcagacaagtcttgcccacccccgagtccccgatcagcagcaacttgaagaggtggtcgtaggctttgg

SEQ ID NO: 990 - DNA, 499 bp, Homo sapien
cctcaaccaagagggttgatggcctccagtcaagaaactgtggctcatgccagcagagctctctcctcctccagcaggcgccatgcaagggcaggctaaaagacctccagtgcatcaacatccatctagcagagagaaaaggggcactgaagcagctatgtctgccaggggctaggggctcccttgcagacagcaatgctacaataaaggacacagaaatgggggaggtgggggagccctatttttataacaaagtcaaacagatctgtgcgttcattcccccagacacacaagtagaaaaaaaccaatgctgtggtttctgccaagatggaatattcctcctcctagttccacacatggcgtttgcaatgctcgacagcattgcactgggctgctgtctctgtgttctggcaccagtagcttgggccccatatacacttctcagttcccaacaagggcttatgggccgaggggcaggctccaattttcaagcacacga

SEQ ID NO: 991 - DNA, 262 bp, Homo sapien
ctgccagccaggctgtggtcagtcctctggcaggcaatcttcggcaccgagagcctctgtccattagtgtcagccccgagggggccacgacggaggccgcccaatgtccactgtgatattggtgaagagtggttgccgagacacctccaagacctggtaccgcactgacccaatgccgtcccgcttcatggtcagcttcgtgttttgaatcttggtaaacctctgagggttaggttcgttatgcttgtcgcggtcgtgcttg

SEQ ID NO: 992 - DNA, 535 bp, Homo sapien
  misc_feature (1)...(535): n = A,T,C or G
ctgctgcttgtgaaattcatgtgtggtactaagtaccttacatgaattatttcatttaaccctcccaacagtctcctttgtacgtgctgnnctctctgcctggaaacactgtttcccacccccaacccccaattcttctgtttatttttcttgagacagagtctcactgtgtagcccagactggagtgcagtggcgcgatctcggctcactccaatctccgcctcccgggtccctgttcaagcagttctcctgcctcagcctcctgagtagctgggattacaggcacacgccaccatgtccagctaatttctgtatttttagtagagatggggtttcacgatgttggctaggatggtctcgatctctggtcagagtcttttctgtaaatatccttggtaaagaagcaattttagactgtagctgttgcaaatgctttaaggaagaagcaaaacaactgtcagtcttnctgaaatgaagaaactacaccagggctgctatatcagagcaaccccaaccagcactncaatcatgatg

SEQ ID NO: 993 - DNA, 232 bp, Homo sapien
ctgctgctctcccctcccagtctctactcactgggatgaggttaggtcatgaggacaccaaaaacctaaaaataaacaaaaagccaaacaagccttagcttttcttaaaggctgaaatgcctggaagtgtccctttatttataaaataacttttgtcatatttcttatacatgtttcttgtaagaaattcagaaactacagacaaagagagtggaaattacccactgtcagg

SEQ ID NO: 994 - DNA, 203 bp, Homo sapien
ccagcagatcatccacgacgaccaccctctgtcctggctccagggcgtctttctgaatctccagctcagccttcccgtactccagggaataggaggcccacagagtggggcctggcagcttcccccgctttcggatgagcacgcagcccagtccaagctcctgggccagggaggggccaaagaggaagcctcgggagtctagg

SEQ ID NO: 995 - DNA, 238 bp, Homo sapien
ccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtcccaaactcctgagatcaagcaatccgcccacctcagcctcccaaagtgctgagatcacaggcgtgagccaccaccagg

SEQ ID NO: 996 - DNA, 379 bp, Homo sapien
ctgcagcctgggactgaccgggaggctctgaccatttacccaccacaggtaggttgtgttctgaacctcaggttcacaggtgaaggccacagcatccttgtcctccacggggttggagttgttgctggagatggagggcttgggcagctccgggtatacatggaactgtccggttgcttcttcattcacaagatctgactttatgacttgtagggtatagaatcctgtgtcattctgggtgacgttctggatcagcagggatgcattggggtatattgtctctcgaccactgtatgcgggccctggggtagcttgttgagttcctattacatatcctacaattagactgttgccatccactctttcgcctttgtaccag

SEQ ID NO: 997 - DNA, 210 bp, Homo sapien
ccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaaggccgtggagaagtgtaaagatgcaggattgg

SEQ ID NO: 998 - DNA, 207 bp, Homo sapien
  misc_feature (1)...(207): n = A,T,C or G
ggtggctgtgctgggggcgccccacaaccctgctcccccgacgtccaccgtgatccacatncgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggccca

SEQ ID NO: 999 - DNA, 315 bp, Homo sapien
ccaatgggctttgctgtagcttgctgaaatcaccaagcaggagagatttaaccagaggcgatgtgtccagtcaccagcatagagccatcctctgtgtcaccatccacacgcagggccttctggcagacctcatgcaatgccctccatgttaatattcatcagaaaatggataattaggggggccagcaaaaatatcaagggtcaaatatcgcacatttctgtttaggccatctatggctttcatctcctctgaagtcaactggaattcaaacacctgcacgttctgtctgatgcgctgctcattgtagctcttgg

SEQ ID NO: 1000 - DNA, 186 bp, Homo sapien
ctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcag

SEQ ID NO: 1001 - DNA, 173 bp, Homo sapien
ccacaaagcggaaactcatccacttttgcctttttccgccccaggtcaaaaatgcgaatcttggcatcagggacacctcggcagaagcgagactttgggtacggcttgttcttacaataccggtaacaacgggcggggcggcggcccatggcgacaccaggatcttcagtggc

SEQ ID NO: 1002 - DNA, 302 bp, Homo sapien
ctgaatgcctgagcccagcagggagctgaggatcatggggtactgggggggcctgaagacgtcgccgtgcaccaacttccacccagactcctccatggtgtcttcaatgtcatcctccttgttgtagttggcaatgtccttccggagggtccgaatgataatcatgctcaggatacctgacaggaagaagaccacaacaacggagttaatgatagaaaaccagtggatctggacgtcactcatggtcaggtaagtgtcccagcgagaggcccatttgatatcactttcctcccagtggacag

SEQ ID NO: 1003 - DNA, 368 bp, Homo sapien
cctgggcccgctgacttcagggtgaggccacagctactgcagcgctttttatttatttatttatttactgagatggagtcttgctctgtcacccaggctggagtgcagtggtgcaatctcggctcactgcaacctctgcctcctgggctgcagtgattctcctgcgttcaagtaattctcctgcctcggccttctgagtagttgggattacaggcatatgccaccacacttggctaattttttgtatttttagtagaaatggggtttcaccatgttggcgaggctggtctcgaactcccgacctcaaggatcctcctgcctcggcctcctaaggtgctgggattgcaggtgtgagccaccacgtctgg

SEQ ID NO: 1004 - DNA, 294 bp, Homo sapien
ctgggcggatagcaccgggcatattttggaatggatgaggtctggcaccctgagcagtccagcgaggacttggtcttagttgagcaatttggctaggaggatagtatgcagcacggttctgagtctgtgggatagctgccatgaagtaacctgaaggaggtgctggctggtaggggttgattacagggttgggcacagctcgtacacttgccattctctgcatatactggttagtgaggtgagcctggcgctcttctttgcgctgagctaaagctacatacaatggctttgtgg

SEQ ID NO: 1005 - DNA, 414 bp, Homo sapien
ctgaagcactcttcagagactacgtccacagacactgatgctgaggcctttcttgtaagtgaagaaaaaggaatgcagcaaagaagagttcgacattggagtccttagttccatcaggatcccattcgcagcctttagcatcatgtagaagcaaactgcacctatggctgagataggtgcaatgacctacaagattttgtgttttctagctgtccaggaaaagccatcttcagtcttgctgacagtcaaagagcaagtgaaaccatttccagcctaaactacataaaagcagccgaaccaatgattaaagacctctaaggctccataatcatcattaaatatgcccaaactcattgtgactttttattttatatacaggattaaaatcaacattaaatcatcttatttacatgg

SEQ ID NO: 1006 - DNA, 272 bp, Homo sapien
ccggagcccacggtggtcatggctgccagagcgctctgcatgctggggctggtcctggccttgctgtcctccagctctgctgaggagtacgtgggcctgtctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccag

SEQ ID NO: 1007 - DNA, 313 bp, Homo sapien
  misc_feature (1)...(313): n = A,T,C or G
cctgccttactctnttccctttccccagggactcttggttttcagaagcccctctggaatgtcctacctggcctaaccccataccagcagtgcagacaaggaggcactcctactatagtgggtccagcccatggagagactcacttcctgccccaacacctcttcccctagaccctgagggccaggacaatgtcttagtgccttccaacttggcagagtgaggccccatgagacagagagaaagggggaagagggaaatacctttatccaaataaatacccatccaaaattatttgtgataggtgaaaaatgg

SEQ ID NO: 1008 - DNA, 317 bp, Homo sapien
cctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctaccaagcgacccactgattattttgcggaaatgg

SEQ ID NO: 1009 - DNA, 456 bp, Homo sapien
tttttttgtagggtatagaaaatacatttttaattttgatagagttcacaaatgacagcattgacatttctttaaacaaatacttctgtcaaggcacagcattaccatgtgtccccagatgcccaagaggcagtgatttcatgtccccctgaggtttagcagagccaccaatgtcaatagggtggctgacggggcctagatttgctaccagataagccaatgagacatgctgtcagatttatggttacataatcaagtatttaaaaagatgcacaataggtaactgcaatgagcttgttctgcatttagcgatagttcctttcaaacaaagaagatagttttcagtatcaagaaggatgcctatatgtatgtcttccatggagcctttcctacaaattgctttcattacacattaaaaggagttcagctttattgtgaccttcttgagtcattcag

SEQ ID NO: 1010 - DNA, 196 bp, Homo sapien
ctgggcatgggctgaggagaggtcttgcttgcccccttcaactttccatctcagaactataaactgctaggctgcaaggagagaagggctaagtgggggtcagacaggagagaagggcaggaggcagtgagccccgatgacccaccaactccaccaggccctgacagggaagcccctttggttagtatcattttgg

SEQ ID NO: 1011 - DNA, 449 bp, Homo sapien
ccttgcggctgctgcgaaaggccacggcgctgcctgcccgccgggccgagtactttgatggttcagagcccgtgcagaaccgcgtgtacaagtcactgaaggtctggtccatgctcgccgacctgaaggagagcctcggcaccttccagtccaccaaggccgtgtacgaccgcatcctggacctgcgtatcgcaacaccccagatcgtcatcaactatgccatgttcctggaggagcacaagtacttcgaggagagcttcaaggcgtacgagcgcggcatctcgctgttcaagtggcccaacgtgtccgacatctggagcacctacctgaccaaattcattgcccgctatgggggccgcaagctggagcgggcacgggacctgtttgaacaggctctggacggctgccccccaaaatatgccaagaccttgtacctgctgtatgcacag

SEQ ID NO: 1012 - DNA, 289 bp, Homo sapien
  misc_feature (1)...(289): n = A,T,C or G
ccaggaccacaaccccacgctgtagctggtagcgcagggcaatcagggctggggttcgcttgtgcttttttgccaaggcacaaaggactgggtcctccaagagcaccggggagttcgggtccacccatggttcttctcggtgggatcccagagcactataggcaaccagaacaatgtcttttgacttgcagaaatccagcagttttctctggttgaagtaaggatgacattccacctggttgcagacaggcttgtacttgagccctggcttgtnnaggatcatctccag

SEQ ID NO: 1013 - DNA, 221 bp, Homo sapien
  misc_feature (1)...(221): n = A,T,C or G
tctgtaaatgctgcgttcctaatttagtaaaataaaagaatagacactaaaatcatgttgatctataattacacctatgggatcaataagcatgtcannactgattaatgtctactgtaaaaatttggtagnnaaattttcatttgatattagatataaatatctgaatataaataattntaatatactagtcatgatgtgtgttgtattttaaaaattat

SEQ ID NO: 1014 - DNA, 512 bp, Homo sapien
gggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagccggcgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatga

SEQ ID NO: 1015 - DNA, 553 bp, Homo sapien
  misc_feature (1)...(553): n = A,T,C or G
ctgggcaggaagattatgatcgcccgaggcccctctcctacccagataccgatgttatactgatgtgtttttccatcgacagccctgatagttcagaaaacatcccagaaaagtggaccccagaagtcaagcatttctgtcccgacgtgcccatcatcctggttgggaataagaaggatcttcggaatgatgagcacacaaggcgggagctagccaagatgaagcaggagccggtgaaacctgaagaaggcagagatatggcaaacaggattggcgcctttgggtacatggagtgctcagcaaagaccagagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcangaagtcatcttgctaccagtatttagaagccaact

SEQ ID NO: 1016 - DNA, 431 bp, Homo sapien
ccacttcacatgatggcgggcctttaagagcacaaagaagtttaatatggacaacaacaggaaaaagcaagaagaaaacaagtagggaaagacagctaacctggagagagagaatttctttaacctttatgttcttcattaaaaatcttatcttggactgatttgagggatttttagaaacatggccttattttatataagcattaccttcccaggaatctttgttgtatattaatttttgataaccatttgattaactttaaaattaagtatatgtgtgtatatatacatatgtatgtttatatacacacatgtatctgtatagttttatatatacatatatacacatagacatacagagaaccactactttgtaatagtgtacagtttgttttatatctctttactttttttgttactattttatctgt

SEQ ID NO: 1017 - DNA, 490 bp, Homo sapien
  misc_feature (1)...(490): n = A,T,C or G
ctggaagaacaaggcgaagttctggtggctgtctgcgatgaatgtgcccttggctttggctgggtatgtcacccgggtagttttgggtgcaatgctctgatccttatccacggtggaaagatcaacatttgtgatgccaacttcagtggagatcttgactctgagctctacggtatttgcaatataccggttgtcaccttcaacttcgacaaggaagtcataataaccactggaaaatttgacgttcatgaaatttagttcaaaaacatcccctacaggggtgaaggatgtcttctggaggacagtggctctggaagcaacagatttagcatgttctagtttaacagtggcctgagtcagaggctgagacagaacattggtgacttgcaaccgcaagatagcctgttcatgagtgtcggaagcaganccctcangcacaaccacaactggcacgtggtagcgattatgcgagagcacaggcagacctcgg

SEQ ID NO: 1018 - DNA, 503 bp, Homo sapien
ggagtaagctgagtacaagtaccatagcagcagagctgcaaaaggtcttgggacctatagtcctaatgcaagataaggtcatggggcctaaggccatggggcctgaggcacccctagaccctgagccttcagcatttaagggagggtgtccccccattctcgataggccatggtacacagatgggtctagccgaggtgctataactgcttggaccactgttgcagtccaacctagtactgacactatatggtttgaaacccggtgtggacaaagtagccaatgggctgaacttagagcagtgtggatggtgatcaccaaggaggtgacactgatggtaatctgtatcaatagctgggtggtctaccaaggcttaactttgtggttaactacctggaaaatacagaagttgctagtcggccaccaacccatttggggtcaagccacgtggcaagacctctgggaaatgggtcatcagaaacaggtaaccgtttatcatgtgtca

SEQ ID NO: 1019 - DNA, 348 bp, Homo sapien
cctgtgtatggagtagaggcgggtgcacgggtactgttcctcacggcagtcaagaggcccaggctctgtgggctccagctctgcatttcccggttctggggttggggctgggatgacttcctgttggacttgctgctgggactggaactggaactgttcctcggagggccgaggagtcacctcttgataatcatagtagtctgggttgtcgatctggtcgctatagtgggtgtactggacgtggtcagggaacggcggcagcgggtccaggtcatactggccctgagccagcaagcctgcaggcaggaatagcaggaagaggtaggcagctctcatggcaacaaagag

SEQ ID NO: 1020 - DNA, 260 bp, Homo sapien
ccacacggcgaccgagggacagatggggccctgcgtcccataggctgcctgaaggtgggtagggcggcctgcggcatagtggggtggctgtgggctcccagcctggcccctgggaaccgtgggagcacagggacaagcacatggctatggaatgcagggtgacccaaggacaagcgagttgcggggatctctactgtgaccatgcagaattgatcgcagtctgctgcgccaccaccacctcatgttcccgaggggaacag

SEQ ID NO: 1021 - DNA, 407 bp, Homo sapien
ccttatgactataacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttgg

SEQ ID NO: 1022 - DNA, 140 bp, Homo sapien
ccaccccagagtgggagaggctgggaggttgggaggctgtggagagaagtgagcaaggtgctcttgaacctgtgctcattttgcaattttatcagtaatttgacttagagtttttacgaaacctcttttgttgtccttgc

SEQ ID NO: 1023 - DNA, 280 bp, Homo sapien
ctggaggtgcctcagaaggtgcattctgcttcctgcaggggcttgaaacaccaaggcactccagggatcctggagtcaaagcagcagccccggttgttgcactccttgggggtgacatgggggtagccgcagtccaccctgtccttggctggcacggcacactggtttgcagacaggcccgcgtactcctcagcagagctggaggacagcaaggccaggaccagccccagcatgcagagcgctctggcagccatgaccaccgtgggctccgggacgcagc

SEQ ID NO: 1024 - DNA, 274 bp, Homo sapien
  misc_feature (1)...(274): n = A,T,C or G
cctggctgagcaggcagagcaccctgggaccccagggcagaaggacccctgccctccagtccccaagacccaggcccgtctccactcatacacgccacctacatgtgacgtcagccctgaaaaggtaacaggaaagttcagaacaaaaacaaaaccccaaaagtaaaaaggctacgtgtagcagagtaataccggaaacgttatatacacaggcggtgatggccccctcggaagtgtccgggtcacttagggggcactgcanaggtccctgtgg

SEQ ID NO: 1025 - DNA, 446 bp, Homo sapien
  misc_feature (1)...(446): n = A,T,C or G
gcaaagagtgtactgtgcttgaggcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatcaaaaaanaaanaaaaaaaanaaaaaa

SEQ ID NO: 1026 - DNA, 189 bp, Homo sapien
ctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcag

SEQ ID NO: 1027 - DNA, 92 bp, Homo sapien
ccagaccctccttagtacaggatctcggaccacaaaccaaggagtctcgtggccttggattcccagaccctaggatggtatccctctgacag

SEQ ID NO: 1028 - DNA, 438 bp, Homo sapien
ctgaaaagccatctttgcattgttcctcatccgcctccttgctcgccgcagccgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcag

SEQ ID NO: 1029 - DNA, 330 bp, Homo sapien
ccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaatcgcaacgtagctgtcatcaacgtgggggcacccgcggctgggatgaacgcggccgtacgctcag

SEQ ID NO: 1030 - DNA, 228 bp, Homo sapien; identical to SEQ ID NO: 903

SEQ ID NO: 1031 - DNA, 294 bp, Homo sapien
ccacaaagccattgtatgtagctttagctcagcgcaaagaagagcgccaggctcacctcactaaccagtatatgcagagaatggcaagtgtacgagctgtgcccaaccctgtaatcaacccctaccagccagcacctccttcaggttacttcatggcagctatcccacagactcagaaccgtgctgcatactatcctcctagccaaattgctcaactaagaccaagtccccgctggactgctcagggtgccagacctcatccattccaaaatatgcccggtgctatccgcccag

SEQ ID NO: 1032 - DNA, 278 bp, Homo sapien
ggaggtattacagacagcactgcactttggagttgggcagctacatcgaggacctctttgtggtccacagtgacctctccagcattgtgatcctggataactccccaggggcttacaggagccatccagacaatgccatccccatcaaatcctggttcagtgaccccagcgacacagcccttctcaacctgctcccaatgctgggtgccctcaggttcaccgctgatgttcgttccgtgctgagccgaaaccttcaccaacatcggctctggtgacgg

SEQ ID NO: 1033 - DNA, 155 bp, Homo sapien
  misc_feature (1)...(155): n = A,T,C or G
cgcgttcanccatgttnaaaccgattgcatnaacttcgaaaccggcccgcccgccggcgcctggagaggggcanngggagaagcagagagtttatcattcatctgtacacatagacgtttcttctttaaataacaccacgggcgggagccccatc

SEQ ID NO: 1034 - DNA, 401 bp, Homo sapien
ctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaagg

SEQ ID NO: 1035 - DNA, 333 bp, Homo sapien
ctgagctgggggttgaatttctccaggcactccctggagagaggacccagtgacttgtccaagtttacacacgacactaatctcccctggggaggaagcgggaagccagccaggttgaactgtagcgaggcccccaggccgccaggaatggaccatgcagatcactgtcagtggagggaagctgctgactgtgattaggtgctggggtcttagcgtccagcgcagcccgggggcatcctggaggctctgctccttagggcatggtagtcaccgcgaagccgggcaccgtcccacagcatctcctagaagcagccggcacaggagggaaggtgg

SEQ ID NO: 1036 - DNA, 198 bp, Homo sapien
ccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaagg

SEQ ID NO: 1037 - DNA, 289 bp, Homo sapien
ctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctgg

SEQ ID NO: 1038 - DNA, 368 bp, Homo sapien
ccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccagg

SEQ ID NO: 1039 - DNA, 417 bp, Homo sapien
  misc_feature (1)...(417): n = A,T,C or G
ctgggcctatgctggtcatgaacggtcctggaaaatgactcccttccttcagtatctgcatcctcatgaagtcattcattttggagatcgtgtcttcacttttcttggtgaagaaactgctggatggagttgttggtggcatctgaggagtccgaagatggctctcagggaaggttgtgctggcctctgaaggatttggaagctgactctgttcctggggtagctnnatgctcttggggtcattgnttctcgggtttgnttttttctttatctggataaaactatgcatttctgaaatcagttttgacatctggttcttttttcctaagtcgaaagcagaaaagttggaagcttatctccttcttcacagggggatattgtggacattgnnctgtccccactacatccatttttcct

SEQ ID NO: 1040 - DNA, 409 bp, Homo sapien
ctgtccaatggcaacaggaccctcactccattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcag

SEQ ID NO: 1041 - DNA, 492 bp, Homo sapien
  misc_feature (1)...(492): n = A,T,C or G
cctcggctccacacctccgctgtgaccacagcctcaggtcaagctgtgctggggccatccaccttcctttgccatttagaagatggggcttggagcttggcaacacagaaattgacatcagccttataaaaccttggctgaacctaccgacctccaggagaatttcagccaaaacaaaaaagcaaatacacagagggaccctggaaccagaatccctccccatgggaaagacgaaggcacagagattcgagccaagtttcccaacatgttggtgtttgcagaaaagtccggtcacgtcacacacagcacagaggcaagaagcgaaggcagtggcattcacaggactactttatattaaagtttattacatttggaaaatctactgtacagggaaaaacccattggattaagtagagttttgccaaaagcaaaagactatcactctttggaaaatattcctgattccagcccanggcccagggtggggccaca

SEQ ID NO: 1042 - DNA, 125 bp, Homo sapien
cctggctctgatccagtgacccctctcaccaaagaactcggtttaaccagggctctgtaagaccactcccacccagagacttgtgtggcctggtgtggcctgtgtgtcggattccttcctgtcag

SEQ ID NO: 1043 - DNA, 459 bp, Homo sapien
ccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaagggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctgg

SEQ ID NO: 1044 - DNA, 368 bp, Homo sapien
cctgggcccgctgacttcagggtgaggccacagctactgcagcgctttttatttatttatttatttactgagatggagtcttgctctgtcacccaggctggagtgcagtggtgcaatctcggctcactgcaacctctgcctcctgggctgcagtgattctcctgcgttcaagtaattctcctgcctcggccttctgagtagttgggattacaggcatatgccaccacacttggctaattttttgtatttttagtagaaatggggtttcaccatgttggcgaggctggtctcgaactcctgacctcaaggatcctcctgcctcggcctcctaaggtgctgggattgcaggtgtgagccaccacgtctgg

SEQ ID NO: 1045 - DNA, 315 bp, Homo sapien
ccaatgggctttgctgtagcttgctgaaatcaccaagcaggagagatttaaccagaggcgatgtgtccagtcaccagcatagagccatcctctgtgtcaccatccacacgcagggcctcctggcagacctcatgcaatgccctccatgttaatattcatcagaaaatggataattaggggggccagcaaaaatatcaagggtcaaatatcgcacatttctgtttaggccatctatggctttcatctcctctgaagtcaactggaattcaaacacctgcacgttctgtctgatgcgctgctcattgtagctcttgg

SEQ ID NO: 1046 - DNA, 317 bp, Homo sapien
cctcgcctggagggccccgggcagcacagggaggacgagcttgtccagcagagggtctggcagagggtcccgcagaggtttgggcagggggtctgacatccctggctcctgctctggctctggctgccgggatttgcacaggcccaggtgcatacagatgccgtttgagtcaatctggttctggaagtagtcgatgaccagggggaagtagtcgtcaagcacttggttgcactggggcatgagcagcttcaaggggaggacgttgcactcctgctccaggaacttcctcaccgtgtcctggaaaatggcctccttgg

SEQ ID NO: 1047 - DNA, 412 bp, Homo sapien
  misc_feature (1)...(412): n = A,T,C or G
gtacaagctttttttttttttttttttttttttgtttaatgcttgaactttattttggagagagaaatttagaaagacacaaggtacacagagtaaaatgtttttcttttttcaggaccttgaactgaatcttgcactgctttggtttctatctaggaagctcagcgacagcagagtctgtanaggcggccactgatttcacacaccccggagagggactcacgggtagcacaacggccggttcggcaatagcaggtggctcttgcctganaacctgaggttctaanagcananagtccatttcctgcaaaggagatagcaaggtcctggttgtcttccccanactgcttctgggttgtagcctcatcagctctttcctggagtgactcagcctgggcctgcagggccacca

SEQ ID NO: 1048 - DNA, 476 bp, Homo sapien
  misc_feature (1)...(476): n = A,T,C or G
taaaaaaaggaaaaagttttattacgaaactagtttgtataaaacagggttatacatatttttgtaagtttgtaataaaacagtaagaaaaaaaggcagtaatagaaatctccaaaaggcaacctatcaaaaccaactggctgccactttgagtttggacagtagctgcataaactttgttcttcttgaacagtatttaataacatcattaatacattaacaacatttctataaagtaagacacattggtgctgaagtacaactggnggcctcttgatctcacctatgaggagagttctttacaaaaccacatagggaaaattgcagttgtaaggngaactacncatctaaaatatgcanaggtaatagcattacatgttaaaggtatcaagggnatatacacattttaaaccatttgnnacaaaacttntataaaatttntttctctctctttctctcttatgcacaaaaaatat

SEQ ID NO: 1049 - DNA, 274 bp, Homo sapien
cctggctgagcaggcagagcaccctgggaccccagggcagaaggacccctgccctccagtccccaagacccaggcccgtctccactcatacacgccacctacatgtgacgtcagccctgaaaaggtaacaggaaagttcagaacaaaaacaaaaccccaaaagtaaaaaggctacgtgtagcagagtaataccggaaacgttatatacacaggcggtgatggccccctcggaagtgtccgggtcacttagggggcactgcagaggtccctgtgg

SEQ ID NO: 1050 - DNA, 472 bp, Homo sapien
ctgcagcctgggactgaccgggaggctctgattatttacccaccacaggtaggttgtgttctgaatctcaggttcacaggttaaggctacagcatcctcatcctccacggggttggagttgttgctggtgatgaagggtttgggtggctctgcatagactgtgatcgtcgtgactgtggtcctattgaggccagtgtctgagttatgggcttggcacgtataggatccactattattcacagtgatgttggggataaagagctcttgggtggattgctggaaagtcccattgacaaaccaagagtactgtgcaggtgggttagaggctgcgtggcaggagaggttcagattttcccctgatctgtaagatgtgtttagaggggaaatggtgggggcatccgggccatagaggacattcaggatgactgaatcactgcgcctggcactcactgggttctgggtttcacatttg

SEQ ID NO: 1051 - DNA, 249 bp, Homo sapien
ccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagacctgc

SEQ ID NO: 1052 - DNA, 289 bp, Homo sapien
ccaggaccacaaccccacgctgtagctggtagcgcagggcaatcagggctggggttcgcttgtgcttttttgccaaggcacaaaggactgggtcctccaagagcaccggggagttcgggtccacccatcgtttgtctcgttgagatcccagagcactataggcaaccagaacaatatctttcgacttgcagaaatctagcaatttactccggttgaaatacggatgacattctacctggttgcagacaggcttgtacttgagtcctggcttgttgaggatcatctccag

SEQ ID NO: 1053 - DNA, 199 bp, Homo sapien
ccacgactgcatgcccgcgcccgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatctttacaagaggaaaccgtaagaaagggcccagccg

SEQ ID NO: 1054 - DNA, 224 bp, Homo sapien
tcgaccctgtgaagcaggagacagatgctgcattttcactgttgtttgtcctctgtttttgtagcatccccgggaacttccccatcagccaggggcttgtccccaccacccttcacctggctttccagttggctgagacgctgcttcatcttcatctgggtggcgttgtactcagccaggaggcgtgcaaacctggtctgcagggcgtccagggaggaccccag

SEQ ID NO: 1055 - DNA, 390 bp, Homo sapien
cctcttattagggctctggtagcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttgccaacgccatcaccgacctcatcagtgagctgtccctgctggaggagcgctttcgggtgg

SEQ ID NO: 1056 - DNA, 450 bp, Homo sapien
  misc_feature (1)...(450): n = A,T,C or G
ccagcatcaccttttggtccnnacactccagggctgccaggagcaccagtgttacccgcaggacctgggggcccatccttgcctggagaaccgctgggacctgggggtcctgggttaccattactaccaggaggaccaggaagaccacgagcaccagggaagccagcagcaccaggtccaccaggactgccacgttcacctttgacaccttggggaccaggaggaccagnangtccagaacctccagggggtcctgcaactccaggagggcctccttcacctttctcacccggagcccctctttctcctttaccaccaggttcaccattctgtccaggagcaccagggaaaccagcaggtcctggagggccagtttnacctctctcaccanggctaccacgaggtccagctatacctggaagtccgggggcaccaccttcacccttacct

SEQ ID NO: 1057 - DNA, 337 bp, Homo sapien
tgagcggccgcccggcaggtcctcgcctggagggccccgggcagcacagggaggacgagcttgtccagcagagggtctggcagagggtcccgcagaggtttgggcagggggtctgacatccctggctcctgctctggctctggctgccgggatttgcacaggcccaggtgcatacagatgccgtttgagtcaatctggttctggaagtagtcgatgaccagggggaagtagtcgtcaagcacttggttgcactggggcatgagcagcttcaaggggaggacgttgcactcctgctccaggaacttcctcatcgtgtcctggaaaatggcctccttgg

SEQ ID NO: 1058 - DNA, 237 bp, Homo sapien
ctggggactgggaatgctagcatatggtatctcaagttggctctcagaactaaacggggataagggcctagaatggaagagggaaccagccagaccctcagtccttcctgtcctggactgggagccacagatgtccctgtgatctgtcactgccctgatctgggtcttcagccattaaagctcagtgtcatcttcagtcaccaacgggggtcttggtgtccttccaaacccctttgg

SEQ ID NO: 1059 - DNA, 210 bp, Homo sapien
  misc_feature (1)...(210): n = A,T,C or G
agcccatccccccggctccctcctagtctgccctgcgtcctctgtccccgggtttcagagacaacttcccaaagcacaaagcagtttttccccctaggggtgggaggaagcaaaagactctgtacctactttgtatgtgtataataatttgagatgtttttaattattnngattgctggaataaagcatgtggaaatgacccaaaaaaaa

SEQ ID NO: 1060 - DNA, 564 bp, Homo sapien
ctggccacagagcccagcaagtccttcctgggagagaagagttagggctgatactgaaggtctctttcacatctgggcacacgtctgccttcaggctgtaagaatttcatttgtcgattgttaaataaaaccaggagaaagcaatgcaggtctctgggaatctcatcccttccataaggaaaatgctctgccaattcaagtttcattcagtcaggaagacagaaggatttaaggcttcggtgacaattataatcctctgagaaattatttccccttaaagtcaagataagataatagtgtttactgtactttctcttgactcttgaaatccctggtattgggtgtaggcaacttgcacctgcaatgaagtccgcaggagaggaaggtctctcctcccccgaaagctatcccaggtcacatgcgtggcgaatgcccactgaacctcggctctcatggaagcaggaaagacaccgagattcaagccttctagtaggttgaggacgctgtgctcatggcatcttcggagattttggtactggcaggggtggatgcttgcaaaatact

SEQ ID NO: 1061 - DNA, 267 bp, Homo sapien
cctatggaggtgcctatgatgtcatgagctctaagcacctttgtggtgataccaactatgcctggcccaccgcagagattgcggtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttgg

SEQ ID NO: 1062 - DNA, 603 bp, Homo sapien
  misc_feature (1)...(603): n = A,T,C or G
ctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaaagtccggctggcgtnccccaagccctgagatgctctgtcaccttcaaaggatggtgtcagagcagtgccacctnctgtctcagtt

SEQ ID NO: 1063 - DNA, 222 bp, Homo sapien
ccatcgtggatcactgagatgcagtggcggtccccgtagctggcccgtggcatgccaccctggaagatggtgaagggcaacccctgcctagtggtcagccggaggattctggtaatcgctttgcaaggaaagggaccgtaaggcacgaggctgcggaggggctctggttgctgggcttcgctggacacgggccactggcagtagctgccgtcagagtgacag

SEQ ID NO: 1064 - DNA, 72 bp, Homo sapien
  misc_feature (1)...(72): n = A,T,C or G
gatgatcaatatnnactggaacacatgcatgcttttggaatgtataattacctgcactgtgattcatggtat

SEQ ID NO: 1065 - DNA, 251 bp, Homo sapien
gtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcag

SEQ ID NO: 1066 - DNA, 289 bp, Homo sapien
ctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccagtgctcttggaggacccagtcctttgtgccttggcaaaaaagcacaagcgaaccccagccctgattgccctgcgctaccagctacagcgtggggttgtggtcctgg

SEQ ID NO: 1067 - DNA, 301 bp, Homo sapien
ctgtagttgactgaagtcgctaaacaggacggatttaagtagaggtgatatgtccagtcaccggcatagagacgtcctctgcgtcaccatccacacacagggcttctggtagacatcaggcaaagctctccatgttaatattcatctgaatatggataattagggtggctagcaaaactatcactgttaaaatagtggagatttctgtctaggccatctatggctttcatgtcctccgcagtcaactggaactcaaaaacctgcacgttctgtctgatgcgctgctcattgtagctcttgg

SEQ ID NO: 1068 - DNA, 255 bp, Homo sapien
ccagcagttcctctttgccttatatttgtggtacgcccggccagccttcaagatgggtttgtcaattcggccacctccagccaccacaccaaccacagctctgttggctgaggagataaccttcttggagccggagggcagcttcacacgggtcttcttggtctcagggttgtgggagataacggtggcatagttccctgatgcccgggccagcttgccacggtctccaggcttctcctccaggcagcacacgat

SEQ ID NO: 1069 - DNA, 77 bp, Homo sapien
ctggacaggctccagcaccggcccaaacacgcccagacctcggcaggcaccacctggttctcccacccagaaagttc

SEQ ID NO: 1070 - DNA, 163 bp, Homo sapien
  misc_feature (1)...(163): n = A,T,C or G
ctgctgggatgnctgccaagtttttcagccataaggtagcgaaatctagcagaatccagattacatccacttccaatcacgcggtgtttgggtaatccacctagtttnnaggtaacatacgtaagaatgtccactgngttggaaacnncaattatgatgcaat

SEQ ID NO: 1071 - DNA, 246 bp, Homo sapien
  misc_feature (1)...(246): n = A,T,C or G
ctgaccggaccggncatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagacaaaaaaaaaaaaaaaaaaacaaa

SEQ ID NO: 1072 - DNA, 224 bp, Homo sapien
  misc_feature (1)...(224): n = A,T,C or G
ctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcangtaattattcgaggtggaggacatattttaccctatgaccagcctctgagagcttttgacatgattaatcgattcatttat

SEQ ID NO: 1073 - DNA, 301 bp, Homo sapien
ctgtagttgactgaagtcgctaaacaggacggatttaagtagaggtgatatgtccagtcaccggcatagagacgtcctctgcgtcaccatccacacacagggcttctggtagacatcaggcaaagctctccatgttaatattcatctgaatatggataattagggtggctagcaaaactatcactgttaaaatagtggagatttctgtctaggccatctatggctttcatgtcctctgcagtcaactggaactcaaaaacctgcacgttctgtctgatgcgctgctcattgtagctcttgg

SEQ ID NO: 1074 - DNA, 132 bp, Homo sapien
  misc_feature (1)...(132): n = A,T,C or G
caagctttttttttttttttttttttttttttcgctcaaanactttnttttattantacatgggctggnattgatggnaagggacaaatgtanttggcaaccatggttagcatcggatgcccatcccaatgg

SEQ ID NO: 1075 - DNA, 301 bp, Homo sapien; identical to SEQ ID NO: 1073

SEQ ID NO: 1076 - DNA, 436 bp, Homo sapien
ctgctgggatgaatgccaagtttttcagccataaggtagcgaaatctagcagaatccagattacatccacttccaatcacgcggtgtttgggtaatccacctagtttccaggtaacatacgtaagaatgtccactgggttggaaaccacaattatgatgcaatcaggactgtacttgacgatctgaggaataatgaatttgaagacattaacatttctctgcaccagattgagccgactctccccttcttgctgacggactcctgcagttactactacaatcttagaattggcggtcacagaataatctttatctgccacaattttaggtgtctgaagaaataagctcccatgctgcagatccatcatttctcctttaagcttatcttccaaaacatccacaagagcaagttcatcagccagagactttcccagaa

SEQ ID NO: 1077 - DNA, 256 bp, Homo sapien
ctgaagattaataggaaacagtgaaaaagcaacgtcctgtgatcagtaactttaaagacaagcttggttctctctttctggcactactgacattcccaccattctagcttccgaattctggaaaaagagaagatgattaacaaaaatagagaatgtagaaacttctggttttgtgcctacaggattggcaccagaccctcagtgctcacttgctccatctacaaggcagcacccctcccagaggcagccagggagg

SEQ ID NO: 1078 - DNA, 202 bp, Homo sapien
  misc_feature (1)...(202): n = A,T,C or G
ctgtgctncncaaccagatccatgtnaagtgccccgcccagagaagggagccagggggagctgactncagncaacanccagtgnccggatgancaccaacatgtgaggggtgaaccttggcctccangacatntgcaccccctncccacctccacggacctcggacctccaggcggctcagtgctgcctgcggcccagctaa

SEQ ID NO: 1079 - DNA, 170 bp, Homo sapien
gcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctgg

SEQ ID NO: 1080 - DNA, 494 bp, Homo sapien
cctgcggcaaagagatgcgcttattgagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgaggaaagttgaagatgaattgaaagca

SEQ ID NO: 1081 - DNA, 123 bp, Homo sapien
ctgctgctattaagttgcaagctctacagctagctacatgactgatggatcagtttgagatttgttcccttgtcaaaagtttaactctgatagaaggttggcctcacattctgatgtttggac

SEQ ID NO: 1082 - DNA, 297 bp, Homo sapien; identical to SEQ ID NO: 389

SEQ ID NO: 1083 - DNA, 452 bp, Homo sapien
ctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtgtacgtatatgtatatgcaacacctgtgagacccccattcaggtcaaggaaaaccattgcctgcaccccaagggccccatatttgcccctccccatcacagtcctgcccttcaccctcaagcacggtcctaaacttgtctgcactttagaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcag

SEQ ID NO: 1084 - DNA, 301 bp, Homo sapien
ctgtagttgactgaagtcgctaaacaggacggatttaagtagaggtgatatgtccagtcaccggcatagagacgtcctctgcgtcaccatccacacacagggcttctggtagacatcgggcaaagctctccatgttaatattcatctgaatatggataattagggtggctagcaaaactatcactgttaaaatagtggagatttctgtctaggccatctatggctttcatgtcctctgcagtcaactggaactcaaaaacctgcacgttctgtctgatgcgctgctcattgtagctcttgg

SEQ ID NO: 1085 - DNA, 369 bp, Homo sapien
ctgtttcccatgggccaccaggcggctcaggacagcaaacgtctcatcccctctcaggatgtacttctccatgtcctgctcgatccactggtacatgaggcccttcacatgcacgtctcggatggcgtccgtcacgtccttgtagagatgtgcttggtcaaactccaggctgtggcccagaaagtagtccaccacacaggacagcagagccatctccggtagcgagaagatgtccatgaactgcttaatggagggacccttgccatagaagccactcatctggtatagtgggatgtgctgggtacccccatacagctcaatcacctcctcgtctggcacaggctggaggcccctgtaggctgtccccag

SEQ ID NO: 1086 - DNA, 316 bp, Homo sapien
cctcagaggtttctccacagtcctcttctgggcaaattcttgtttcttcacatgccggactagcttaagaccaatgcagtagcttatttccaagccttgcaaagtatataatatctaagaggaaaggttttgtcatcccagcgttgtccactttgtggggctttgtaggtagacggagccacactacaggcagggtatgagcagagggatgtatggagtgtgggtgactctgagcctcactgccgctgcaaggtggggaaactgtaagtgaacccctgtgggtgcgggggagggtatccggtgcgcagggaggtgg

SEQ ID NO: 1087 - DNA, 329 bp, Homo sapien
cctgcaggggatgggaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctggttctctttggagctgtgatcgctggagctgtggtcgctgctgtgatgtggaggaggaagagctcagatagaaaaggagggagctactctcaggctgcaagcagtgacagtgcccagggctctgatatgtctcccacagcttgtaaagtgtgagacag

SEQ ID NO: 1088 - DNA, 342 bp, Homo sapien
ccactcactgctgggacccaggcacctcccttctccatcctctctggattgtcagtaatgtcctggaacagaagcctgtgggatggccttgggcacggagaagccctggggtcagtgtcgtgcacggatggcggcagtgttgaacccaggaggctgaacccggcccaccacggaagatgagtgcatggcaaccgcctgccttcacgtcgctccacttggtaaccccaaggtctgggctgttctaggtattgcttcacgtgccccagcaagcccttaacaagagggcctggttccctgaagaaccaatcccaggaaggggccttgatccctccgccttgctga

SEQ ID NO: 1089 - DNA, 51 bp, Homo sapien
  misc_feature (1)...(51): n = A,T,C or G
ccttgtgttcagtctccncgctcttcttgccactgttgagggtggagatgt

SEQ ID NO: 1090 - DNA, 515 bp, Homo sapien
cctggggaggccctaggggagcaccgtgatggagaggacagagcaggggctccagcaccttctttctggactggcgttcacctccctgctcagtgcttgggctccacgggcaggggtcagagcactccctaatttatgtgctatataaatacgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagagggaaagttacagatttcctgtagcaggtgtgggcttacagacacatggactgg

SEQ ID NO: 1091 - DNA, 277 bp, Homo sapien
gcgtcccggagcccacggtggtcatggctgccagagcgctctgcatgctggggctggtcctggccttgctgtcctccagctctgctgaggagtacgtgggcctgtctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccag

SEQ ID NO: 1092 - DNA, 368 bp, Homo sapien; identical to SEQ ID NO: 1044

SEQ ID NO: 1093 - DNA, 459 bp, Homo sapien
ctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcacagagcccctgatgctgttgttctttgagggcttaagg

SEQ ID NO: 1094 - DNA, 610 bp, Homo sapien
  misc_feature (1)...(610): n = A,T,C or G
ccatgcaaaaggaggtggtgcactcagtgcagtcgctgccacaaaaagtccgattattttcattggtacaggggaacatatagatgactttgaacctttcaaaacacagccttttattagcaaacttcttggtatgggcgacattgaaggactgatagataaagtcaacgagttgaagttggatgacaatgaagcacttatagagaagttgaaacatggtcagtttacgttgcgagacatgtatgagcaatttcaaaatatcatgaaaatgggccccttcagtcagatcttggggatgatccctggttttgggacagattttatgagcaaaggaaatgaacaggagtcaatggcaaggctaaagaaattaatgacaataatggatagtatgaatgatcaagaactagacagtacggatggtgccaaagtttttagtaaacaaccaggaagaatccaaagagtagcaagaggatcgggtgtatcaacaagagatgttcgagaacttttgacacaatataccaagtttgcacagatggtaaaaaagatgggaggtatcaaaggacttttcaaaggtgggcgacatgtctaanaatgtgagccagtcacagat

SEQ ID NO: 1095 - DNA, 232 bp, Homo sapien
ccttatttctcttgtcctttcgtacagggaggaatttgaagtagatagaaaccgacctggattactccggtctgaactcagatcacgtaggactttaatcgttgaacaaacgaacctttaatagcggctgcaccatcgggatgtcctgatccaacatcgaggtcgtaaaccctattgttgatatggactctagaataggattgcgctgttatccctagggtaacttgttccg

SEQ ID NO: 1096 - DNA, 377 bp, Homo sapien
ccacgctcatggaaaccacccaaggacagccagagtccacattccctggcaagctgggtgtattcttccaaaagtttcccacccagtggttcagacaggtgtagcgtctctgcagggtcccgtgcaatgaagtcaaatgcctcaggcaggaaagccaggcaggcacccagtctggcagcctctcgaaccagcccagcacatgttttaaagttctgttgcttgtctggcgtcgatgttacctggcacacagccaccaggggcagttcgcaggaggaagaggagatagccatggctctgggcctgggctgagcacaaagtactgagagttgaggtatccggagtccaggacacagaagggacaggaatctgtgaggagg

SEQ ID NO: 1097 - DNA, 311 bp, Homo sapien
ccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacactgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtgg

SEQ ID NO: 1098 - DNA, 404 bp, Homo sapien
ccacccacgcttaggttcccatcacactgatgactccgggtttggcgagcacaggagcgcaaaccttttcacattctttctgtgatccaaatttgttttcgtttccaccacaacctccataccagaatcttgcacagcttttggtgtttggatcatagtaccattttaatatgaaatccctgcaagttccttcgtctttcggcaacttgcatatatctgtttcagtgagagccaatggttctgtgctcaccattagattgatggttgaactagaagctgaccttgctggctgtggaggtgggggctgagatttctttgtactgaaacttccgtggtaggtggctctgacctgagacctcaggtagcagaccacagccacatggtatgtctgcccagcgagcagg

SEQ ID NO: 1099 - DNA, 442 bp, Homo sapien
ccatgggatggctcttctgaccattgggggccaggccaggccaggccaggcttagggtagcaaggaccaggccaaaggggcagggcctcctttggaggggttgaggggtacatcctcggctggtgtttgcatccaggggtccagcaggatctcttccagtgagggtcgggaagaaggtttgggggccaggcaccggcggattagggcacagcagtctggggagacatgggctgggaagtggagctcagcttccagaatctcctggtccctctcaaagggaatgtccccacacaccatgtcatagaggaggatgcccagtgaccagacagtggccgggagtgcatggtactggtgtcgagagatccactctggggggctgtacacccttgtcccatcaaagtcagtgtagggttcatcatgaagcagggcaccaggaaccaaa

SEQ ID NO: 1100 - DNA, 191 bp, Homo sapien
ccacgaaaatcaatgagaagccacaggtgatcgcggactatgagagcggacgggccatacccaataaccaggtgcttggcaaaatcgagcgggccattggcctcaagctccggggaaaggacattggaaagcccatcgagaaggggcctagggcgaaatgaacacaaagcctcgaaatcagtgcgctccag

SEQ ID NO: 1101 - DNA, 178 bp, Homo sapien
cgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctgg

SEQ ID NO: 1102 - DNA, 209 bp, Homo sapien
agccaggctagtgacagaaatggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactgg

SEQ ID NO: 1103 - DNA, 396 bp, Homo sapien
  misc_feature (1)...(396): n = A,T,C or G
ctatagggctcgagggccgcccgggcaggtggtgcctctaatactggtgatgctagaggtgatgtttttggtaaacaggcggggtaagatttgccgagttccttttactttttttaacctttccttatgagcatgcctgtgttgggttgacagtgggggtaataatgacttgttggttgattgtagatattgggctgttaattgtcagttcagcgttttaatctgacgcaggcttatgcagaggagaatgttttcatgttacttatactaacattagttcttctatagggtgatagattggtccaattgggtgtgaggagttcagttatatgtttgggattttttaggtantgggtgttgagcttgaacgctttcttaattggtggctgctttagg

SEQ ID NO: 1104 - DNA, 342 bp, Homo sapien
  misc_feature (1)...(342): n = A,T,C or G
ctgctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatggtaaggcantnctttgccattggaggctccgggagctcctacatctatggctatgttgatgctacctaccgggaaggcatgaccaangaagagtgtctgcaattcactgccaatgctctcgctttgg

SEQ ID NO: 1105 - DNA, 551 bp, Homo sapien
ctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacggaaaagactctgaccagagatcgagaccatcctagccaacatcgtgaaaccccatctctactaaaaatacagaaattagctggacatggtggcatgtgcctgtaatcccagctactcaggaggctgaggcaggagaactgcttgaacagggacccgggaggcggagattggagtgagccgagatcgcgccactgcactccagtctgggctacacagtgagactctgtctcaagaaaaataaacagaagaattgggggttgggggtgggaaacagtgtttccaggcagagagaacagcacgtacaaaggagactgttgggagggttaaatgaaataattcatgtaaggtacttagtaccacacatgaatttcacaagcagcag

SEQ ID NO: 1106 - DNA, 280 bp, Homo sapien
ctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagggctcctgcacctcaacaatgtcagcactggctgcatcctgctgggcggactcttcatctacgatgtcttctgggtatttggcaccaatgtgatggtgacagtgg

SEQ ID NO: 1107 - DNA, 570 bp, Homo sapien
ctgattagtgtctaaggaatggtccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagct

SEQ ID NO: 1108 - DNA, 386 bp, Homo sapien
ctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacag

SEQ ID NO: 1109 - DNA, 409 bp, Homo sapien
ctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctgg

SEQ ID NO: 1110 - DNA, 215 bp, Homo sapien; identical to SEQ ID NO: 890

SEQ ID NO: 1111 - DNA, 308 bp, Homo sapien
cctgggcccgctgacttcagggtgaggccacagctactgcagcgctttttatttatttatttatttactgagatggagtcttgctctgtcacccaggctggagtgcagtggtgcaatctcggctcactgcaacctctgcctcctgggctgcagtgattctcctgcgttcaagtaattctcctgcctcggccttctgagtagttgggattacaggcatatgccaccacacttggctaattttttgtatttttagtagaaatggggtttcaccatgttggcgaggctggtctcgaactcctgacctcaag

SEQ ID NO: 1112 - DNA, 177 bp, Homo sapien
ccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtgg

SEQ ID NO: 1113 - DNA, 646 bp, Homo sapien
  misc_feature (1)...(646): n = A,T,C or G
ccccaccatggacacactttgctacacactcctgctgctgaccaccccttcctgggtcttgtcccaggtcaccttgaaggagtctggtcctgtactggtgaaacccacagagaccctcacgctgacctgcaccgtctctgggttttcactcagtaatattagagtgggtgtgagttggatccgtcagcccccagggaaggccctggagtggtttgcatacattttttcgactgacgaaaaatccttcaattcatctctgaagaacaggctcaccatctccaaggacacctctaaaagccaggtggtccttagcatgaccaacatggaccctgtggacacagccacatattactgtgcacggctctctatttacttcggggagttagaaacctaccaatacatggacgtctggggcaaagggaccaccgccaccgtctcctcagcatccccgaccagccccaaggtcttcccgctgagcctctgcagcacccagccagatgggaacgtggtcatcgcctgcctggtccanggcttcttcccccaggagccactcagtgtgacctggagcgaaagcggacanggcgtgaccgccagaaacttccccacccagccaggatgcctncggggacctgtacaccacgagcag

SEQ ID NO: 1114 - DNA, 420 bp, Homo sapien
tgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggtggaaaacagccagctttggcgctgttggggagactcctccagaccaggaaccccagaaggagacagagcctgccacatcctcccacgccaggccctgggccagggtgattggactgagaatttgg

SEQ ID NO: 1115 - DNA, 416 bp, Homo sapien
ctgaaagtttctaaaatagaaacctggtgcatatggccccaaaacaccacatgctttgattacactcagggagcatgagttgcctatttgggtgagaaaatcccatgttacagtgcgatcgctgggcacgttttggagtaattccagccactgctatgtaagtgtttttaattcaggggtgtcttctacgttttcatcttctgaatatcttgtgacggtgcaggtttgagcaaaactggcatgaaatgagagctgttttagatgaagattgcaagatggatggcttggcccacagtggcagtgggttgggggtggaatgtggacaattaggaaaaaggcatgtcattctatctggctcctggagaggcagatagtcctgggggctttggtgtcacagttcccaaaagcaaggttgg

SEQ ID NO: 1116 - DNA, 382 bp, Homo sapien
ccttatttctcttgtcctttcgtacagggaggaatttgaagtagatagaaaccgacctggattactccggtctgaactcagatcacgtaggactttaatcgttgaacaaacgaacctttaatagcggctgcaccatcgggatgtcctgatccaacatcgaggtcgtaaaccctattgttgatatggactctagaataggattgcgctgttatccctagggtaacttgttccgttggtcaagttattggatcaattgagtatagtagttcgctttgactggtgaagtcttagcatgtactgctcggaggttgggttctgctccgaggtcgccccaaccgaaaatttttaatgcaggcttggtagtttaggacctgtgggtttg

SEQ ID NO: 1117 - DNA, 370 bp, Homo sapien
ctgcgtgtctgaaaaccaaagatttaaaacatagtaattattgaacctcagaagaaaaactcagattgaaagagcttagaataagaccctttttgagttgagaaaggtgagtacttagatttttcatttgctttgtttgggattacttacatcagtattttatgttgatcagaaagaaaggattcaattagctattgttcggttaataaaaatgtcagccactgtaggagtaagttggatgtccagcctttttagattgcttaacttggaaacactggactgggagcggtggctcatgcctgtgatcccagcactctgggaggccaaggcaggcagatcactggaggtcaggagtttgagaccaacctgg

SEQ ID NO: 1118 - DNA, 494 bp, Homo sapien
ctgtctcttacttttaaccagtgaaattgacctgcccgtgaagaggcgggcataacacagcaagacgagaagaccctatggagctttaatttattaatgcaaacagtacctgacaaacccacaggtcctaaactaccagacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataagg

SEQ ID NO: 1119 - DNA, 407 bp, Homo sapien
ccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagtcggttgtaatgcagcctgagaaattccagtccaagtatgagccccggagccacatgatggacgtccagggctccacccaggactcggccatcaaggacttcgtgctgaagtacgccctgcccctggttgg

SEQ ID NO: 1120 - DNA, 548 bp, Homo sapien
  misc_feature (1)...(548): n = A,T,C or G
ccccagaggacccgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatggcttcactcaagtctgttaatggacaaatagaaagcctcattagtcctgatggttctcgtaaaaacccagctagaaactgcagagacctgaaattctgccatcctgaactcaagagtggagaatactgggttgaccctaaccaaggatgcaaattggatgctatcaaggtattctgtaatatggaaactggggaaacatgcataagtgccaatccttngaatgttccacggaaacactggtggacagattcta

SEQ ID NO: 1121 - DNA, 278 bp, Homo sapien
cggccgaggtccgccatggcgtgtgctcgcccactgatatcggtgtactccgaaaagggggagtcatctggcaaaaatgtcactttgcctgctgtattcaaggctcctattcgaccagatattgtgaactttgtttacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctgg

SEQ ID NO: 1122 - DNA, 591 bp, Homo sapien
ctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcact

SEQ ID NO: 1123 - DNA, 454 bp, Homo sapien
ccaattgaaacaaacagttctgagaccgttcttccactactgattaagagtggggtggcaggtattagggataatattcatttagccttctgagctttctgggcagacttggtgaccttgccagctccagcagccttcttgtccactgctttgatgacacccaccgcaactgtctgtctcatatcacgaacagcaaagcgacccaaaggtggatagtctgagaagctctcaacacacatgggcttgccaggaaccatatcaacaatggcagcatcaccagacttcaagaatttagggccatcttccagctttttaccagaacggcgatcaatcttttccttcagctcagcaaacttgcatgcaatgtgagccgtgtggcaatccaatacaggggcatagccggcgcttatttggcctggatggttcaggataatcacctgagcagtgaagccag

SEQ ID NO: 1124 - DNA, 219 bp, Homo sapien
cctgctccagagcacggctgaccatttctgctccgggatctcagctcccgttccccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaatattcaaactaat

SEQ ID NO: 1125 - DNA, 246 bp, Homo sapien
ccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggttcaaaagaaa

SEQ ID NO: 1126 - DNA, 227 bp, Homo sapien
ccattgttcccgtgcatcgaagcttgcaggcagcttcaggtcctcggtaaacataactctctggggtggcttgggcccacccaggaaggtaccacatagcctcttcaagtagctcatgtccacgttgtagaagttgtggccggcctgccacgtggtattccgtttgttgacatagttgaccagctcatccgacaggggatggaaagagggcctgctccgggcattgg

SEQ ID NO: 1127 - DNA, 377 bp, Homo sapien
cctgccgtcgatgccagggaggccgacaggaccttcttttccagcggggccgatatttccaggggaaccaggaagacctctgggtcccatgagaccaggctccccagggcgaccagcatctccattaggtcctcggactccagcagggccacttgcaccacgactaccaggagggcccatgacgccagctctgccatcagctccaggaagaccacgagaaccaggactacctctcagcccaggaggtcctggagggccggcagatccagcttccccattagggcctctctttccttcttcaccactgggaccaggaggaccttggggcccagcagagccgggctcacccttgttaccgctctctcctttggagccag

SEQ ID NO: 1128 - DNA, 253 bp, Homo sapien
gagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaagacactgtcctttaaagtgctgcagtatgg

SEQ ID NO: 1129 - DNA, 314 bp, Homo sapien
ccaagagctacaatgagcagcgcatcagacagaacgtgcaggtgtttgaattccagttgacttcagaggagatgaaagccatagatggcctaaacagaaatgtgcgatatttgacccttgatatttttgctggccccccaattatccattttctgatgaatattaacatggagggcattgcatgaggtctaccagaaggccctgcgtgtggatggtgacacagaggatggctctatgctggtgactggacacatcgcctctggttaaatctctcctgcttggtgatttcagcaagctacagcaaagcccattgg

SEQ ID NO: 1130 - DNA, 239 bp, Homo sapien
ccagtccaacctgctcctcattattgtataaatgagcagaatcaatatggcggaagtcagcttcaattgccaatttggtggcctctaaagctttacttttaggaacctctgcaggcgcataggtgccaaatcccaggacaggcatgaagtgaccatcattcagcttcacacactgatatttcgaatccatttctgtcactagcctggctagcaaatgtttcttcctccctcacaggcta

SEQ ID NO: 1131 - DNA, 402 bp, Homo sapien
aaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggac

SEQ ID NO: 1132 - DNA, 304 bp, Homo sapien
ccaccccggagatgacacgaggctcacatgactctagacacttggtggaaagtgaggcgagaaaaacaatgacttgggccaattacacgactgcaaagctagagctgccaacagggctccagggagcttggcttctgtagaagttctaaggaagcggtacgaactccacggcggtggggcgctaactagcagggacccctgcaagtgttggtcgggggcctcgagctgcctgagctgacacgaggggaggggtctgtgtagccaacaggtgaccgaagggcttgcctgcccacagcttacttgg

SEQ ID NO: 1133 - DNA, 224 bp, Homo sapien
ctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcagcgatggattttgggtggggaagtcctccttgcggagttggcgccagctagctcttgaacag

SEQ ID NO: 1134 - DNA, 250 bp, Homo sapien
cctactctgctgaggtggcgcttcctgctaagggcccttctctgccctttctgccctccttcccatcccacatgctgagccgccacaaagaccaaagaagtgatggcttttctctgtcccctgctgctctgaggggagaggggtgggtctcctgagccactcagatgggaaagtcccttactcggcccctccctccccagcagccccaagctttacactggatgcagcgatcaacccaccactcaccagg

SEQ ID NO: 1135 - DNA, 315 bp, Homo sapien
ccaatgggctttgctgtagcttgctgaaatcaccaagcaggagagatttaaccagaggcgatgtgtccagtcaccagcatagagccatcctctgtgtcaccatccacacgcagggccttctggtagacctcatgcaatgccctccatgttaatattcatcagaaaatggataattaggggggccagcaaaaatatcaagggtcaaatatcgcacatttctgtttaggccatctatggctttcatctcctctgaagtcaactggaattcaaacacctgcacgttccgtctgatgcgctgctcattgtagctcttgg

SEQ ID NO: 1136 - DNA, 377 bp, Homo sapien; identical to SEQ ID NO: 1127

SEQ ID NO: 1137 - DNA, 250 bp, Homo sapien
ctgttcaacttccaactctaaataggcaccattaaacaaaaaaccccagtattttaaatttctccagcacacattccaggatcaatgctctgaactgtaatcagctagtaattcataacgggaatacagccttagaatggaagctatattgcttccctgccccctttctcttacaattggagagtgtaggtattaagggatacaaagtcagaggaagaataattaaaaagaaaaatgcccaaagctgcag

SEQ ID NO: 1138 - DNA, 511 bp, Homo sapien
  misc_feature (1)...(511): n = A,T,C or G
tcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcagggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaangaggaaagggtgctgctggtcctcctgggccacctggtgctgctggtactcctggtctgcaaggaatgcctggagaaaga

SEQ ID NO: 1139 - DNA, 505 bp, Homo sapien
ctgtggactccagcatgtttctgataattatgcaagcaacaattctgtagcctcaagtaagaccacctgtgaacttgatcattatctggcccaaatatgaagataaactataactttggagtttgtttcctatttgtattcacattctgcttcctaaatcagttttctaaattgtgcctgcaattaggcattggtcaggggtgaatggctcttttcacagagagtagccaaccagagacctttgctttgatatcatcaactgcagagaatgctgttgatgggaatgctggaagcagaaactttgtcatcggaaaaacttttcttgtatgcatgagactcaacatcaggatccacagcttaaagatgggaattcaggtatgaaagaaaacaggcaaggaggcactgagggagaaagacacagactttatcgctctgtggctcattgttactggaatattctaaaactcttgttcacatgctattatgacttataaagcagcaacag

SEQ ID NO: 1140 - DNA, 256 bp, Homo sapien
ctgtagcttctgtgggacttccactgctcgggcgtcaggctcaggtagctgctggccgcgtacttgttgttgctctgtttggagggtttggtggtctccactcccgccttgacggggctgccatctgccttccaggccactgtcacagctcccgggtagaagtcactgatcagacacactagtgtggccttgttggcttggagctcctcagaggagggcgggaacagagtgacagtggggttggccttgggctgac

SEQ ID NO: 1141 - DNA, 371 bp, Homo sapien
ccagggccccattctgtctgtgggactgtgggttctcagtggaattgttgcctttcttgtcgtggagaaatttgtgagacatgtgaaaggaggacatggtcacagtcatggacatggacacgctcacagtcatgcacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctgg

SEQ ID NO: 1142 - DNA, 312 bp, Homo sapien
  misc_feature (1)...(312): n = A,T,C or G
cctcccacactgtcaaatgtcaactccaccagcactgagacaatgagtagatgagaatgtagaaagagggaaggtggtaggtaaaggagcggaaggaagaggtggggaaagagggaaggtggtaggtaaaggagcggaaggaagaggtggggaaagagggaaggagagaagggaaggagggaagagaaagaaggaagaaaaggaaagcatggcccggctagagacaaagccagaggtgatcaggtcagcagcaggagaggctcagaagggagcctctcgggaagtgcaggcngccatgagggctcgtttcag

SEQ ID NO: 1143 - DNA, 367 bp, Homo sapien
ccagacgtggtggctcacacctgcaatcccagcaccttaggaggccgaggcaggaggatccttgaggtcaggagttcgagaccagcctcgccaacatggtgaaaccccatttctactaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgactgagcaagactccatctcagtaaataaataaataaataaaaagcgctgcagtagctgtggcctcaccctgaagtcagcgggcccagg

SEQ ID NO: 1144 - DNA, 159 bp, Homo sapien
cctggaggagcggccgcacacacagccaggcgctaggctccctgcgggacctcgggaagggggaagagcgtcaacgatttacggagggtccagccgctgggtcagattgagacaaaccattgtgtggttgggttcgggtcagcaggctggagagggttc

SEQ ID NO: 1145 - DNA, 450 bp, Homo sapien
ccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcag

SEQ ID NO: 1146 - DNA, 324 bp, Homo sapien
ccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctgga

SEQ ID NO: 1147 - DNA, 191 bp, Homo sapien
ccacgaaaatcaatgagaagccacaggtgatcgcggactatgagagcggacgggccatacccaataaccaggtgcttggcaaaatcgagcgggccattggcctcaagctccggggaaaggacattggaaagcccatcgagaaggggcctagggcgaaatgaacacaaagcctcgaaatcagtgtgctccag

SEQ ID NO: 1148 - DNA, 344 bp, Homo sapien
ctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtgg

SEQ ID NO: 1149 - DNA, 329 bp, Homo sapien
ctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctgg

SEQ ID NO: 1150 - DNA, 406 bp, Homo sapien
ccagttatttgcaagtggtaagagcctatttaccataaataatactaagaaccaactcaagtcaaaccttaatgccattgttattgtgaattaggattaagtagtaattttcagaattcacattaacttgattttaaaatcagttttgtgagtcatttaccacaagctaaatgtgtacactatgataaaaacaaccattgtattcctgtttttctaaacagtcctaatttctaacactgtatatatccttcgacatcaatgaactttgttttcttttactccagtaataaagtaggcacagatctgtccacaacaaacttgccctctcatgccttgcctctcaccatgctctgctccaggtcagcccccttttggcctgtttgttttgtcaaaaacctaatctgct

SEQ ID NO: 1151 - DNA, 346 bp, Homo sapien
ctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacag

SEQ ID NO: 1152 - DNA, 427 bp, Homo sapien
ctggactgctgtacatcaaggacagattaactggaaaacatatgttccttatgcgtgatcgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacagagcccaacaatgatctcaggaattacattttccaacagaccaaaaaatgttttcatgtagcagcaatgcagatttggtgaatatttaatatatattttagtatgtatttcactttatgactgacaattaaaaaatattgtttgg

SEQ ID NO: 1153 - DNA, 331 bp, Homo sapien
ctggccggcggtgcagatctggagtccagcctcagggatgcgctactttccattctctgcattgaacattcgttctgtcagcatccgctccagcttcactgcatcagcggcaaacttgcggatcccgtcagagagcttctccacagccatctggtcctcgttgtgcaaccaacggaaagacttctcatccaggtggattttttccaggtcactggcttgggctgggggacaagaaccagccttccatgcctgctccatgtccctgcccaccttggccccttgggctcagggcctgaaccgctgcacccaagcatctcccaccagggccagg

SEQ ID NO: 1154 - DNA, 403 bp, Homo sapien
ctgaactttcagatgaagttgacttctacttgattgcaggattcagggtttctcagatgttaatacagagtcaaaagcggtggataaaaccttgcaaatggcttgtgcttgttccaggctgttgcactgataaacccacaggctgtattcctcattgcttgcatctgtggtcttcagagccagtaagctttttcccgcccccagaccgtcatcgtaacacaccatccggattattaagtagagagcatgcctgtgcaaaacatcatattgatctgatgttgatacttttatgccatacttggaaactcccataataaattcttcctccggaggaacaaaaggcaactttccatcttgctgggcaacgtctatataatttatcaggtctaatggcccttcaagg

SEQ ID NO: 1155 - DNA, 491 bp, Homo sapien
cctccctctcagagcttgccccagggactctctggccctcagggttcaatgtattctgaccaaggccaagctttcctggggctcagggaaaatcacactttgctacccgaagctgtatcccctcagatgccaggaaggccgtgatcatctgactccaccctcctgagacacattctctccctgactgtcctgttctaagtcagcggagcaccttaggatggaggggtggaggcgaggccagatgcagcctctgtgaacaggtgcctggaggctgggaaatgaccctgagagggcaggacacagcaaccgtgggcttaaggtgaccttgagagcaagcttggcccactttacaattctgttcagagccagcccctaacatggtggtcatttattcatttgttccctcattttaaaaaatgtaaggccaggcatggtggctcacgccgggtaatcccagcactttgggaggccgaggcaggcagatcacctga

SEQ ID NO: 1156 - DNA, 586 bp, Homo sapien
agcaaatagaagcaatcagggcactgcaagttgtgactactccaagatgtgaatcatggatcatgcaaattacaatcatgttttaacctgacctccaaagggagaataaagtaaaaattatcccatgtgaggattattcaccagtttatatgtcattagttaccagtttttctttatgaataatgtttagcaatattataaagtatatctaatagttatcaggtttttggcttgttactttttggtagtaacttataaaactgactggaaaagaccaataaggcactgtttgcatgttacaaattatatccaaagaccaaaagctgttaataagaaatcttccaataaaaccacatcatattttcttttttatttacacccacatcaggattacaactttatcaggactgcaccttgatcaggaagggatgtttctcttacaaggctaataagaaaggaacaataaatttgctgatgaaaaaagtcatgcatttaaaaattttaactttaatttttaattgagggcaatattttaaagaaatgctcattagtcattcctttaaattgtgtgtgtgagagagagaaa

SEQ ID NO: 1157 - DNA, 392 bp, Homo sapien
  misc_feature (1)...(392): n = A,T,C or G
cctccggctggtgttctgagggttgccaggccatcgtggacacaggcacctctctgctcactgtgccccagcagtacatgagtgctcttctgcaggccacaggggcccaggaggatgagtatggacagtttctcgtgaactgtaacagcattcagaatctgcccagcttgaccttcatcatcaatggtgtggagttccctctgccaccttcctcctatatcctcagtaacaacggctactgcaccgtgggagtcgagcccacctacctgtcctcccagaacggccagcccctgtggatcctcggggatgtcttcctcaggtcctactattccgtctacgacttgggcaacaacagagtaggctttgccactgncgcctagacttgctgnctc

SEQ ID NO: 1158 - DNA, 375 bp, Homo sapien
gggaaaaataattttattcctcaaatgatcagcacattcagaagcaggacagaggagctctgatgacatctctgggggactcaaagcggccctcattttctggtattttcccaggtgattctcttccaacctgtgagtcctgctctctttcctcccatctgaagtttgagacatcctctgccacaaggaaagccaccaataccagcccaaagagccaccagagaggaaccaaaccacatgcatcaagttataggaaggatgcaagaagggaaattaggaaggaaagggaggagtttagttggcattctggggcatgctaacatgagggcgatggtctctctccaagtcgctggacatatcccttttctttccagg

SEQ ID NO: 1159 - DNA, 361 bp, Homo sapien
  misc_feature (1)...(361): n = A,T,C or G
gtttattgtaaaaaacaaaaaactctgtattgtgcacatgaagacctggagatgtgccgacttcctgtccccaaagccaatcttccccgccaaggcgactgaggatttcaagggctcagagttactgcaggaatccaggtgacaccaggaagagaagggggaggaggggaatcggaggggatgggtttaaaaggcagaggggagggagatggaagggaatgaggaggagggagactgagggggctgcctttccttggggactggggaactcatgccctgcccccacccgcagggctccaggggtgagagaaaggggtggagaataaagaattgggcancagggtgatggggggaacagcag

SEQ ID NO: 1160 - DNA, 142 bp, Homo sapien
cgcaatgttgccagtgtctgtctgcaggttggctacccaactgttgcatcagtaccccattctatcatcaacgggtacaaacgagtcctggccttgtctgtggagacggattacaccttcccacttgctgaaaaggtcaagg

SEQ ID NO: 1161 - DNA, 193 bp, Homo sapien
ccaaagcctacgaccacctcttcaagttgctgctgatcggggactcgggggtgggcaagacttgtctgatcattcgctttgcagaggacaacttcaacaacacttacatctccaccatcggaattgatttcaagatccgcactgtggatatagaggggaagaagatcaaactacaagtctgggacacggctgg

SEQ ID NO: 1162 - DNA, 265 bp, Homo sapien
cctgggtgccacgattcccagcctggagcgcagccaggacgtgggagaccttctcagagactctccgggcacactctatgagctccttcttggtgtaggcatcactggggctgcactgcagggcgcctgccttggtgaccagagcggcacagccatggcccagctcctgtacccggtgtttgatatgggaacctatctcttcattttcagcagccaccgctgcaggcttggcctccgaggccagacggccatagtcactggtcag

SEQ ID NO: 1163 - DNA, 337 bp, Homo sapien
  misc_feature (1)...(337): n = A,T,C or G
ctgcagagtgggganaggcttttgccactagaaacttccaggatgcacgagatcaaggaattaagtctgtaacaaaataacaggatgctctgtgaagtccaaagaattgcttgaggcaaactgcagagctccatgagatcagcaaccccaagagcttttacaccgccggacacggtttaataggaaaaaaatctcctatactgnntattcanaaccaaatgaanagaaatgtcaaaggagtcggaaacaatatgtcaaattangtaaattcctgacctgacccanattttgcngaacatttgatcctaaactgtgctgtccacgtccttaggatcac

SEQ ID NO: 1164 - DNA, 368 bp, Homo sapien
  misc_feature (1)...(368): n = A,T,C or G
ccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcancccangaggcanaggttgcantgagccgagattgcaccactgcactccagcctgggtgacagagcaagactccatctcagtaaataaataaataaataaaaagcgctgcagtagctgtggcctcaccctgaagtcagcgggcccagg

SEQ ID NO: 1165 - DNA, 267 bp, Homo sapien
  misc_feature (1)...(267): n = A,T,C or G
ctgggaaggaggctcctccgccttctcctgtttgtcatcctcctcatcagactcgacctccatctcaacttcctcactctccccaaacttttcatagcgctcctgaatgaggattcgggcccccagctcctctggcgtggtggggggagggaagttcccttgctcattgggttggaagnccactgtttccaccaccacaaaatcatgccantcnatctgagcataggccacccgntccttctccttctccnnttcttccttcttcct

SEQ ID NO: 1166 - DNA, 433 bp, Homo sapien
  misc_feature (1)...(433): n = A,T,C or G
ctgtctgtacactttttcttgggggaagagttcttgtcttcagtttactgcagtagggttcctggctctgttacatgctcatgtgttccggaagaacacatgaaatatcatcccacggatgacgatacagcccctgcttcancctcttctgatcaagatagtgtccaatgaaccccatactccttcccagcacaaagatgccattgagggctccaatgtcaatatattcatcagcttcctccctgcaacacacatcaacttgtagttttaaaaggctcacgtgactgccctcctccccacagacagtactactactgcccaanaatgagaagaaaaggggtgctctgggtggtngcattacaggcaatttttgttntcttnnttatacctctccttattttncaaatnttctattatgagtntgcattacttt

SEQ ID NO: 1167 - DNA, 362 bp, Homo sapien
cctctggctctttcttcagccacttctccagctcctgcaggttctggtctgagtagtcagtgacgacgatctccttaaaggattcacaagcagagaggagctgatagatagtggggccagagccgatgtcaatcagcaggtctcccttcacaccgtctaggcagaatatcttgaaaagatttttcagaaggtgcttaagaatctggctttctgcagagtgcctagaaccaaacttgtaatatttttctaggtaatcccgagggttaaaatggcttagataggtgtccttggaggtgaagcctgattccattatgtctcacttccgtaccactggagcactgccctccttctctttcctccag

SEQ ID NO: 1168 - DNA, 459 bp, Homo sapien
  misc_feature (1)...(459): n = A,T,C or G
gcagtcatggggcccaggaccatgccactggccctgctcccccagccgcagcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctncatggggcacanacccaacacaaggcggggatgctnccacgccacgtgcacacacacagacccacatgtgggtggggggcaccctcacg

SEQ ID NO: 1169 - DNA, 386 bp, Homo sapien
ccaggccacctgtgcggggctcctcgatgtggaaggttcgggtgaggagattgtagaaggagccgtagcacacggccaccacagtgcacgtgaggcagatcacgctgtagggcatgctgaagtccggtgtcggcaggttcaccagcagcggctccgtgtagagccgcacaaagtagttagagccatcagagactgggaacaggctgttgaagaggggactctcttcccagtccactggcttggctgctaccatgctgggcacaagggcgctgaggacagatgggctgacatagaagccatggttaggatctggcgtgtactcggtccacttcagcagcgcccgctcaaactggatggaaaccttggtgactgagttggccggccag

SEQ ID NO: 1170 - DNA, 480 bp, Homo sapien
ctatttctctgttagtgtttaaccaaccatctgttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcaggaccagaacctgcaggagctggagaagtggctgaagaaagagccaga

SEQ ID NO: 1171 - DNA, 317 bp, Homo sapien
cctcagcagccctgccacggatctgcccgattctttcgcatcaagaagttgatcttgcgagccatttccatgttgtagatccgccggcacctttcatagctttccctctgtcgccggcggcatggcttctcataataccgccgatgcttaatgtcctcaatgagcccatccatagtgaggattctgtttagggtcctgtatgcgctttccacgttcccttcctgtaccatcacagtcctggcgatgaacttcagatgttttgccatgaccttggatttaaaccttcactctgtagagcctcgcgcgctcagtaccta

SEQ ID NO: 1172 - DNA, 202 bp, Homo sapien
  misc_feature (1)...(202): n = A,T,C or G
ggcaacgggaggaacagcagcagaggcagcangagcaggaggagcgtgaacgagaagagcancggcgatnngctgcnctcagtgaccganagaagagagctctggctgcanagcgccgactcgctgcccagttgggagcccctacctctccaatccctgactctgcaatcgtcaatactcgacgctgctggagttgtggggc

SEQ ID NO: 1173 - DNA, 173 bp, Homo sapien
ctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacag

SEQ ID NO: 1174 - DNA, 301 bp, Homo sapien
ccaagagctacaatgggcagcgcatcagacagaacgtgcaggtttttgagttccagttgactgcggaggacatgaaagccatagatggcctagacagaaatctccactattttaacagtgatagttttgctagccaccctaattatccatattcagatgaatattaacatggagagctttgcctgatgtctaccagaagccctgtgtgtggatggtgacgcagaggacgtctctatgccggtgactggacatatcacctctacttaaatccgtcctgtttagcgacttcagtcaactacag

SEQ ID NO: 1175 - DNA, 537 bp, Homo sapien
cctgcagggctcggccgtaggagaaggtcagggcccagggcttcagcagggggcacttgttaatggcattgaggttgatggacgcctcctcctcactctggcctccagacaggaaggtgatcccagtgacagcggggggcactgtgcggcgcagcgctgtgacggtcgccatggcaatctcctcatgagaaaacttctgagtgcaagcatggcctggggtgaccatgttgggcttcagcaaggtgccttccaggtagatgtggtggtcactcagagccttgtagacagcagccagcaccttctcggtcacatactggcagcgcttcaagtcatggtccccatcagggaggatctcaggctccacgatgggcacaatgccattctgctggcagatactggcataacgggccagaacattggcattttccatgatggcgagggctgagggggtgtgttccccaatcttcagcacacaacgccacttggcgaagtcagctccgtccttcttgtactgggcacagcgctcagacagcccat

SEQ ID NO: 1176 - DNA, 384 bp, Homo sapien
  misc_feature (1)...(384): n = A,T,C or G
ctgacaaaaaatgtgaaatttccacaaaatatccaacttatgtgactaaacgcagtagtttttttaaaaggggagatagaaaataaatggttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgnttttccttcctttttgngaaatgtattaagttgtggttcttattgaaacagtattatataatgttngcttaattatatcatgtgatgctcanntctattntgatttattcattagt

SEQ ID NO: 1177 - DNA, 562 bp, Homo sapien
  misc_feature (1)...(562): n = A,T,C or G
ccaacaacatgcaggaagctcagagtatcgatgaaatctacaaatacgacaagaaacagcagcaagaaatcctggcggcgaagccctgggctaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggnaaagtgaatcttggcgcctttaggacatacccaaagggctacaaacctnctgatgaangaccttctgagt

SEQ ID NO: 1178 - DNA, 353 bp, Homo sapien
  misc_feature (1)...(353): n = A,T,C or G
cgcgtctggatggccgaatcattcgcacagactgggacgcaggctttaaggagggcaggcaatacggccgtgggcgatctgggggccaggttcgggatgagtatcggcaggactacnatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttgg

SEQ ID NO: 1179 - DNA, 288 bp, Homo sapien
ccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgaggttgaccccatcaacgcactgcaggctgccatggagggctatgaggtgaccaccatggatgagg

SEQ ID NO: 1180 - DNA, 523 bp, Homo sapien
ctggagagatggagcggtgggcaccgtcatccttcctcatcagccacatagaaggacagtggcgatttcagcccagcttttctgactgcttgtaaattgaagcccagaactggtttgccacctgtgggatcgactcagcattttaaaataggaggcagtcgtgagtgcaggtttcttgcagctccgggtggccctgggctccaggtcaggagacctcagctcctgtccctgatctgtggttgtcaagccttgcagactctaaactcagcatctttatctgtcagacgtagacacgtggctcccgtggttggtgcggttggaatagctgaggtaatacacggacctccaagcactagagcagtatgaggagttctgaggaatggttatcctgcggtgcctgtggtccacagcaagccattcttatcccatccggtttacttcccacagccactttgtaagcataggcattatcctctaccccatcatagaaatgaggaaaagaatcaccaagagagtaagcagc

SEQ ID NO: 1181 - DNA, 493 bp, Homo sapien
  misc_feature (1)...(493): n = A,T,C or G
cacagatgaaggctttgtgatacctgatgaagggggcccacaggaggagcaagaagagtattaacagcctggaccagcagagtaacatcggaattcttcactccaaatcatgtgcttaactgtaaaatactcccttttgttatccttagaggactcactggtttcttttcataagcaaaaagtacctcttcttaaagtgcactttgcggacgtttcactccttttccaataagtttgagttaggagcttttaccttgtagcagagcagtattaacacctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcanagaatgttgtaataagtaaatgccttaagagtatttaaaanatgcttccacattt

SEQ ID NO: 1182 - DNA, 329 bp, Homo sapien
cgcgtctctgacactgtgatcatgataggggttcaaacagaaagtgcctgggccctccttctaagtcttgttaccaaaaaaaggaaaaagaaaagatcttctcagttacaaattctgggaagggagactatacctggctcttgccctaagtgagaggtcttccctcccgcaccaaaaaatagaaaggctttctatttcactggcccaggtagggggaaggagagtaactttgagtctgtgggcctcatttcccaggtgccttcaatgctcatcaaaaccaggcatggggaaggccctggcaaactgctccacccgttgcctgaggttgg

SEQ ID NO: 1183 - DNA, 198 bp, Homo sapien
cctgacagacagaagggcttggagattttttttctttacaattcagtcttcagcaacttgagagctttcttcatgttgtcaagcaacagagctgtatctgcaggttcgtaagcatagagacgatttgaatatcttccagtgatatcggctctaactgtcagagatgggtcaacaaacataatcctggggacatactgg

SEQ ID NO: 1184 - DNA, 224 bp, Homo sapien
ctggaggtgcctcagaaggtgcattctgcttcctgcaggggcttgaaacaccaaggcactccagggatcctggagtcaaagcagcagccccggttgttgcactccttgggggtgacatgggggtagccgcagtccaccctgtccttggctggcacggcacactggtttgcagacaggcccacgtactcctcagcagagctggaggacagcaaggccaggaccag

SEQ ID NO: 1185 - DNA, 367 bp, Homo sapien
ccttttacagatgtcagctttcactggcctccatgcacaacctcccactaccacccaatctgcctgccacagcaaagtgcaggcaccctgggccccctggaggatgcgggcaggggctacagggcatccaggatgtggtcgatcttggtgaccagctcctggcgctttcctgagatgagcttctcattctcaatgtacgtgtctttcttgagcttgccagccaccaggcgctcagcctccaccgccgacttcagcaccagctccttgacctgtgcatccagcttctgcatttcgctcactctgtcgcacagatcagagccctctgtcttcagcctggactgcagcagtgcaatctcactggtcaagg

SEQ ID NO: 1186 - DNA, 188 bp, Homo sapien
ccattaagcggatgctggagatgggagctatcaagaacctcacgtccttccgacctgggcaagagctgtagcctgtcggttgcctactctgctgtctgggtgacccccatgcgtggctgtgggggtggctggtgccagtatgacccacttggactcaccccctcttggggagggagtcctgggcctgg

SEQ ID NO: 1187 - DNA, 379 bp, Homo sapien
gttgatgctactctgaagtctctcaacaaccagattgagacccttcttactcctgaaggctctagaaagagcccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctgg

SEQ ID NO: 1188 - DNA, 384 bp, Homo sapien
cgcgtcggactgcagccagtccgtttcctttctttagccagccatcctggtactgtagtttaggggttgatggtggttgaaattgatttctggctggttactaaggtgcctgctagccattgtataaaattaaaacatgaagaatattttttttttgagcatggctagtggatttaaaacaacacatacctgtcactgctggagtcaaacttataaaaagccttaagtggaaagtgttccagacggagactctgagttaatagaggagtagaagctggtgttaaagttcccacgacgcacatggctttgccagaaactctgtttaatgatcggcctttcacctcttcacttatccttagtcccagtagccaggatacctgatgg

SEQ ID NO: 1189 - DNA, 419 bp, Homo sapien
  misc_feature (1)...(419): n = A,T,C or G
ggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttgagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtnnacttccagcttttgattgaaagtcctagggtgattctatttctgctgtgatttatctgctgaaagctcag

SEQ ID NO: 1190 - DNA, 173 bp, Homo sapien
ccaggtactggcacatcatgctctggatgggggtggtggtgtcctgtaggcagagaaacaggaaattgtcgtagtcagtatcgagcagcgtggcctcgttcgccaccgtatagttgatcttgaacttctttggattctcagtcttctctccaaggaccttcttctcaacacag

SEQ ID NO: 1191 - DNA, 341 bp, Homo sapien
cctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgttcttttctccaagtccaccagtctctgaaattagaacagtaggcggtatgagataatcagga

SEQ ID NO: 1192 - DNA, 324 bp, Homo sapien
ttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacag

SEQ ID NO: 1193 - DNA, 521 bp, Homo sapien
ctgctttgttttctgttggcagtggagggacaaggtgagaggagccaggggtagtcatgaacaccagtgggttctgccctgggcagctccccaccttctttaagagagtactgtgtctcagctccagcagtctcaactgggaagacccaggactcctgctcttttctctaatccctgggagacgaggtccagctaaggtagagtaagcagtcagtgaccaggcaggctggtttgggaggtcactgcctggaggacgggatcttgtattcttcggaagatggctgggaaattcttccctccattacgtagaactttcttcccctcctcagttgaggtgcctagatgtcccacaacggggtcttcactcaggtcctccagaggcacacgctcaaacagtgggtgctcttcgaaatgagtgcacatccagtcgtgtagctccagcacatcggttatggtatacaccagcccctgcataggcaaaatcaccctagacaggaggctgcatgcaacgtcagcagcca

SEQ ID NO: 1194 - DNA, 208 bp, Homo sapien
ccagtgactagaaggcgaggcgccgcgggaccatggcggcggcggcggacgagcggagtccagaggacggagaagacgagggagaggaggagcagttggttctggtggaattatcaggaattattgattcagacttcctctcaaaatgtgaaaataaatgcaaggttttgggcattgacactgagaggcccattctgcaagtggacag

SEQ ID NO: 1195 - DNA, 499 bp, Homo sapien
ccagaaaggaaagacaataattttgttttttcattttgaaaaaattaaatgctctctcctaaagattcttcacctactttggtctccataacttctatgttttctttccttctgacacactagtgcccctaaattgtgatttgcctatacgtttagggccggggttggaagatgttaacaaccatttaagattcatttctgcagtgggagtgggtggagtttcaccctctgggaaaggggcaggtgacaggtatttatcagtcagtgcctctctagctcttgtaggaagaagcacacgcaggatggagtctagaggatgagcgatattgactagcaattcatgggctccctccagcagtgcgagggtcagagtttctggagccttgggaggaggcatccctgtgagggggggttagggagatgggagggcaccaggaaaagtgattagaagtcaggtatgggaaggctaaattaggacagagtcgagtacatctctgct

SEQ ID NO: 1196 - DNA, 455 bp, Homo sapien
ctgacccccctttgtccacagctaagatggcagcagaatgctatgtcactatatacagaaacaagacaacctgaagctaaatggatgccccctgcagagtcaacaggtccagcctcacagtgcacgccctgagctacagcctctcccaaaaggcatcttccccacagcctcaacgccgagcaaggagcatcaagggtttgtctcggttgttttgttctttttacaaactatagatatatacagttgaaaactcaggatttctagccaataaccatagttaccaccaccttacaaataaaaagaaaatgccagaaacatctttaaatgccttgtcacaccaacagcaaagtgcacagagtgaggagaacacgagagtgccttttcattttaaaaatgtttggaaatatgtacaacttcgatacagtttcagggtgctccagacacccatggacctg

SEQ ID NO: 1197 - DNA, 444 bp, Homo sapien
cctggatgtggctcttcgcactgaaggccaagtagtagatcacaaggccgatcgccgcagccagcacctcagtggacacccagggcccgttccaagtgccccgatggtccacgctgactgtaaacagaggcgggatgatggaaatgtcctcgttattcctctgagccttcctgaggaggctgtaggactcctcgtcgaagaatctaacctcataggtgcctgcgtgggcgctcttgtggttcaggcttcaggacacctgataacgccccacatcctggcctcgagtgacagggaattgttttccaccgacgtcagcatagagagccatgttctggaccctgttcttgcatgtcagggagatctccacaatgaagacggtctcagtggaaatgacagcgtcagaagtggtgtagtaggaaggggtgatctggggctccaggcagg

SEQ ID NO: 1198 - DNA, 450 bp, Homo sapien
ccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactccgcagggggcatccatttagcttcaggttgtcttgtttctgtatatagtgacatagcattctgctgccatcttagctgtggacaaaggggggtcag

SEQ ID NO: 1199 - DNA, 294 bp, Homo sapien
agtcacagttgcacctattcaaaactagctttaaagtgagctatttttaaacttcataaaaatattcatgattttattagtttgaatatttctacaagattcgggtgggcttttcctttaggtgaaaacagctatccactcctgtggccttataactcaggaaatgctggggatgcaaacgtgcaaaaggcagggggaagctgcccaggctgagactggagcagctaggagtgtgcttggggaacgggagctgagatcccggagcagaaatggtcagccgtgctctggagcagg

SEQ ID NO: 1200 - DNA, 258 bp, Homo sapien
agctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtagg

SEQ ID NO: 1201 - DNA, 403 bp, Homo sapien
ctgagctgctgtctgctttggaaaaccgttcctgccgctgccgatggatggaaatgcaatggatttcagcttcttatcatcagccagggccaagcagtttttcactgtcttttccagaagttcttcacacttgtctgcaccccaaactggactattacagtggatcacaaacttggcaggcaggccatggcctgcgctgacagcagctccagctacttccaagggcccgttctttttccggagttccaggacagcttccacaaactccttgccacctttcttctccagcgtgtttcctaggtcatctttaaggtcaatgtcagcattggtaggattgattatggcctccacctcaaagccggctaaattactgatttcactgtgaataaggttcggcttctgg

SEQ ID NO: 1202 - DNA, 325 bp, Homo sapien
ctgaacctgcgggagtcggccaccatcacgtgcctggtgacgggcttctctcccgcggacgtcttcgtgcagtggatgcagagggggcagcccttgtccccggagaagtatgtgaccagcgccccaatgcctgagccccaggccccaggccggtacttcgcccacagcatcctgaccgtgtccgaagaggaatggaacacgggggagacctacacctgcgtggtggcccttgaggccctgcccaacagggtcaccgagaggaccgtggacaagtccaccggtaaacccaccctgtacaacgtgtccctggtcatgtccgacacag

SEQ ID NO: 1203 - DNA, 518 bp, Homo sapien
ctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaaccagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctg

SEQ ID NO: 1204 - DNA, 352 bp, Homo sapien
ggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaagtctagggacaggaagatggttggcgacgtgaccggggcccagga

SEQ ID NO: 1205 - DNA, 250 bp, Homo sapien; identical to SEQ ID NO: 1137

SEQ ID NO: 1206 - DNA, 275 bp, Homo sapien
  misc_feature (1)...(275): n = A,T,C or G
ctgctctcgnngnctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccnnacaggccccattgtgtggggggagccagggaccaatgg

SEQ ID NO: 1207 - DNA, 182 bp, Homo sapien
ccatctcctgctcgaagtccagggcgacgtagcacagcttctccttgatgtcgcgcacgatttcccgctcggccgtggtggtgaagctgtagcctcgctcagtgaggatcttcatgaggtagtcggtcaggtcccggccagccaggtccagacgcaggatggcgtgggggagggcgtagccc

SEQ ID NO: 1208 - DNA, 260 bp, Homo sapien
  misc_feature (1)...(260): n = A,T,C or G
gctggttatgaactcctgacctcaagtgatctgccctcctcagcctcccaaagtgctgggattataggcatgagccactggaatttttctttttttttttctttctttttttttttttttttaaattganacaaggtctggctctatcgcccangctggagtgcagnggcaccatntcggctcactgcaacctctgcctgctgggctcgagccatcctcccacctcagcctcccaagtanttgggactagaggtatgcac

SEQ ID NO: 1209 - DNA, 487 bp, Homo sapien
aaacccactccaccttactaccagacaaccttagccaaaccatttacccaaataaagtataggcgatagaaattgaaacctggcgcaatagatatagtaccgcaagggaaagatgaaaaactataaccaagcataatatagcaaggactaatccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagta

SEQ ID NO: 1210 - DNA, 216 bp, Homo sapien
ccactcagctcagcgggcgacgtgcccctacaagttggcagaagtggctgccactgctgggtttgtgtaagagaggctgctgccaccattacctgcagaaaccttctcataggggctacgatcggtactgctagggggcacatagcgcccatggatgtggtaggtggggtactcgctcataggatggtaggtatcccgggctggaaagatgtccag

SEQ ID NO: 1211 - DNA, 443 bp, Homo sapien
ccaaggtcagaggctgatgcaacaggccctcttctccccagggccaggctcctgtccagcctgggcactgcccagagtgatggcattggtccggatgctgttctgtctctgcttggacaccttcgcaaagatttctttcaggacagtctcaaaggctagctcaacattggtagagtccagggctgaggtctccaggaagagcagtccattgttttcagcgaacattcgggcctcctcagtgggcacttcccgggcctggctgaggtcacttttgttacccacgagcatgacgacgatcgtggcttcagcatggtcatagagctccttcagccatcgctccaccacagcataggtctggtgcttggttaggtcaaacaccaggagggcccccactgcaccacgatagtacgccgaggtgatggctcggtaccgctccaggccag

SEQ ID NO: 1212 - DNA, 526 bp, Homo sapien
actgaaacccgagtaaatgctcaggctgctgcatatgaatacatggctgcatacatagaaaatgcgaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaatgcagactataccactggtcaggtctttgatttgtctgaaaagttagagcagtcagaag

SEQ ID NO: 1213 - DNA, 359 bp, Homo sapien
  misc_feature (1)...(359): n = A,T,C or G
ccagccattgcctgncatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattantangaaaataagtcttttcatgcttatgatttagctgttttgtggtaattgctttttaaaggaagnnattaatatcataagttattattaatattgtgaacnca

SEQ ID NO: 1214 - DNA, 428 bp, Homo sapien
ccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcag

SEQ ID NO: 1215 - DNA, 414 bp, Homo sapien; identical to SEQ ID NO: 1005

SEQ ID NO: 1216 - DNA, 162 bp, Homo sapien
  misc_feature (1)...(162): n = A,T,C or G
cctggccgcagggtcccccggtattgctgttgctacgaggttggggggcagcgattgtcctgtgggagccaccgttctcctgggtcggggaccctcacttcttctggggtgtgctcannttctgcatgccccggatcttgtccagcangccagaaatgaagg

SEQ ID NO: 1217 - DNA, 392 bp, Homo sapien
  misc_feature (1)...(392): n = A,T,C or G
ctgaagtagaggctggaactgaagctgagactgaggctgaggctgaaactggagctaagggtgaggctggaactggagctgaggttgaggccagaactggagctaaagttgaggctggaaccggagctgaggttgaggctggaactggagttaaggttgctggaagtggagctgaggttgaggctggaactgaagctgaggttgaaggtggaagtggagccgaagctagaggtggaactgaggctgaagactgtgcttgctggatccctgtagcctgttttttggcaaatcttggaggaagcttanaagtctggcttcttcctttttcatttgcattctttttgttccagaccttaaaaaattaacggggaccatttttgtcaataatgcag

SEQ ID NO: 1218 - DNA, 526 bp, Homo sapien
  misc_feature (1)...(526): n = A,T,C or G
ctgagctttcagcagataaatcacagcagaaatagaatcaccctaggactttcaatcaaaagctggaagtccaccttacagaaagacaaaaagaaacccctttttatatcttaacaaagcaatagctctcaagcagcagagcatctcgaggaagaaagcttgcccggtcgccatcccatcatgccagagcgtgcagtgtccacccttgactacgctggggaattgctgattttttgaaaaagcttaacttaacaatttctgatgtctatcctttagagttctgtatgttcccattttttattcttctgaattttgaattgcaagtagctgtaaaatccaatctttgagtgcatgggggtgggtgtgaggcggggctcancttcaaccccctgtcctgtaaagcagtggctggtttttcctgagcccagccctgggaggtcgtggtangtgtggaggctgcagagctcctncagatgctgccctcgctgtgcctcacaccanagaggatggaagtgggctctggtgt

SEQ ID NO: 1219 - DNA, 382 bp, Homo sapien
ctggccggcggtgcagatctggagtccagcctcagggatgcgctactttccattctctgcattgaacattcgttctgtcagcatccgctccagcttcactgcatcagcggcaaacttgcggatcccgtcagagagcttctccacagccatctggtcctcgttgtgcaaccaacggaaagacttctcatccaggtggattttttccaggtcactggcttgggccgccttggctgagagcacaggcaccagcttggcgttgtcctgcagcagctctcccaggagcttgggtgagatggtgaggaagtcacagccggccagtgctttgatctcgcccgtgttgcggaaggaggcgcccatgacaatggttttgtagctaaacttc

SEQ ID NO: 1220 - DNA, 127 bp, Homo sapien
tcgacctccttgaagcagaccaagtatagcaagcctctaaaaggactactgagaaacagaatcagaaactctagaactctagttagggcccttcagcagggctgcagagcctccctggatacccagg

SEQ ID NO: 1221 - DNA, 304 bp, Homo sapien
ccaccccggagatgacacgaggctcacatgactctagacacttggtggaaagtgaggcgagaaaaacaatgacttgggccaattacacgactgcaaagctagagctgccaacagggctccagggagcttggcttctgtagaagttctaaggaagcggtacgaactccacggcggtggggcgctaactagcagggacccctgcaagtgttggtcgggggcctcgggctgcctgagctgacacgaggggaggggtctgtgtagccaacaggtgaccgaagggcttgcctgcccacagcttacttgg

SEQ ID NO: 1222 - DNA, 309 bp, Homo sapien
ctgtcgcactcgtagctgcaactcactcaacttgtctttagcagcaatttctgcatagtcattggcatgttcacctacctggatgtccgggtgaactctcagcatgcctccagcaaagagggagaacttggtggaattggagtgaagacagatctggtgctcaccaggggtatgggaagtgaaagtgaacctgccctcggagccatactgccgggccaggatgaccttgtcctctgggtcctccacctccacaaacatgccaagccccggggtggccggctggtactcctcccgctgcttgtcatacag

SEQ ID NO: 1223 - DNA, 390 bp, Homo sapien
cctggcctgggagccctgtgcctactagaagcacattagattatccattcactgacagaacaggtcttttttgggtccttcttctccaccacgatatacttgcagtcctccttcttgaagattctttggcagttgtctttgtcataacccacaggtgtagaaacaagggtgcaacatgaaatctctgtttcgtagcaagtgcatgtctcacagttgtcagtctgccactccgagtttattggtgtttgtttcctttgagatccatgcatttcctggttgaatctcctggaactccctcattaggtatgaaatagcatgatgcattgcataaagtcacgaaggtggcaaagatcacaacgctgcccaggagaacattcattgtgataagca

SEQ ID NO: 1224 - DNA, 407 bp, Homo sapien
ccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttgg

SEQ ID NO: 1225 - DNA, 250 bp, Homo sapien
ctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctgtttagagttggaagttgaacag

SEQ ID NO: 1226 - DNA, 444 bp, Homo sapien
  misc_feature (1)...(444): n = A,T,C or G
cctttaggctgttgctctgggcagggggtgggggtgcgggggcttacagtgggggcccttagttggcacaggttcggaagggccccaggcagacatgaattctcctgagacttgaggtaggttgcttcagccagcccgggcggagaagaagggcagagagcgaacataggagtccagtcgggagcgaaagagctcactttgcacagtttggcccagcgggcacaggggattcttcaccaccagctccacatacagcgcactgtagatgtggtgcagcacatctcggatgggtcccacgcccaagtcagtattcatgacaactttgatcccagtgggcgtctcgtagtaatggagtttgtaacggctagtttggaaggccaggaagccatccttcatgtctagcggggacatcttgctgacaaacgancggatagagaagagcat

SEQ ID NO: 1227 - DNA, 491 bp, Homo sapien
gttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgctttttttttttttttgaggtagagtctcactatgttgcccagactagccttgaactcctgggctcaagtgattctccctcctcagcctcccgagtagctggaacgaactatagttgcaccactgcag

SEQ ID NO: 1228 - DNA, 279 bp, Homo sapien
ctgggcggatctgatcaactaggcaacatcatgtccggatatgagttcatcaacaagttgactggagaagatgtatttggaatcaccgttcctctaattacaagtacaactggagcaaagctgggaaagtctgctggcaatgctgtttggctaaacagagataagacatctccatttgaattgtatcaattctttgtcaggcaaccggacgattcagtggaaaggtacctgaagctgttcactttcctaccccttccagagattgatcatatcatgcag

SEQ ID NO: 1229 - DNA, 199 bp, Homo sapien
cggccgaggtccagtccaacctgctcctcattattgtataaatgagcagaatcaatatggcggaagccagcttcaattgccaatttggtggcctctaaagctttacttttaggaacctctgcaggcgcataggtgccaaatcccaggacaggcatgaagtgaccatcattcagcttcacacactgatatttcgaatcca

SEQ ID NO: 1230 - DNA, 237 bp, Homo sapien
  misc_feature (1)...(237): n = A,T,C or G
ctgcattgntgnggaattcacaactactcaggctgggaaaatacagattggttcaaagaaaccaaaaaccagagtgtccctcttagctgctgcagagagactgccagcaattgtaatggcagcctggcccacccttccgacctctatgctgaggggtgtgaggctctagtagtgaagaagctacaagaaatcatgatgcatgtgatctgggccgcactggcatttgcagctattcag

SEQ ID NO: 1231 - DNA, 277 bp, Homo sapien
ctggaggtgcctcagaaggtgcattctgcttcctgcaggggcttgaaacaccaaggcactccagggatcctggagtcaaagcagcagccccggttgttgcactccttgggggtgacatgggggtagccgcagtccaccctgtccttggctggcacggcacactggtttgcagacaggcccacgtactcctcagcagagctggaggacagcaaggccaggaccagccccagcatgcagagcgctctggcagccatgaccaccgtgggctccgggacgc

SEQ ID NO: 1232 - DNA, 348 bp, Homo sapien
ctgcaactttttttttttgcaattacagagtggtattcagttaacagaacaacaattatttcgtataagctgcatcagagacaactgaagatgaaaaaactaccatccccatatataactaatttgtgctgtgcaccaacaagaacctgctttaaatttccatgccaatttacaacccccatactgtaccaggcaaggttagtggctattgaaaataccaccaggacagggctatctaaagacacattcggtagtgtgttaactatacaaaaaaagacactgtacagtttaaaaacaaatcttacacagccttacatttcaatttttttctttaaaaggagtgagttg

SEQ ID NO: 1233 - DNA, 312 bp, Homo sapien
  misc_feature (1)...(312): n = A,T,C or G
ctgagcgtacggccgcgttcatcccagccgcgggtgcccccacgttgatgacagctacgttgcaattggtctttgggatctgatcatccggcagcttgatggcaagtcgcttgtaggtgttcaggttgcccgcaaagctcctccctcggagtcgaaccgnatnttgaaatctcctctcgtccatcgccttctgcacatcctgagtcatctgcacgcactccatcagcggcaggcgcacggngtggttcccgttcagtgacacgacgcaagctggggtgtccggggtggcctctagcaaggcnatgactgcct

SEQ ID NO: 1234 - DNA, 151 bp, Homo sapien
ccggccgcgggcataaaaggcgccaggtgagggcctcgccgctcctcccgcgaatcgcagcttctgagaccagggttgctccgtccgtgctccgcctcgccatgacttcctacagctatcgccagtcgtcggccacgtcgtccttcggagg

SEQ ID NO: 1235 - DNA, 250 bp, Homo sapien
  misc_feature (1)...(250): n = A,T,C or G
ctgcaccttngggcntntttctttttaattattcttcctctgactttgtatcccttaatacctacactctccaattgtaagagaaagggggcagggaagcaatatancttccattctaaggctgtattcccgttatgaattactagctgattacagttcanagcattgatcctggaatgtgtgctgganaaatttaaaatactggggttttttgtttaatggtgcctgtttagagttggaagttgaacag

SEQ ID NO: 1236 - DNA, 154 bp, Homo sapien
ctgatcctcactattgtgggcaccatcgctggcatcgtcattctcagcatgataattgcattgattgtcacagcaagatcaaataacaaaacgaagcatattgaagaagagaacttgattgacgaagactttcaaaatctaaaactgcggtcga

SEQ ID NO: 1237 - DNA, 375 bp, Homo sapien
ccactggatctttgggattaaagctctgttggatttgtacctcagaggaagatcaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattg

SEQ ID NO: 1238 - DNA, 454 bp, Homo sapien
gtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattccggaagagagtgagaacctgcacaacgctgaccagccactgcgtgtccgtggctgcatcctaactctggtggaacgaatggatgaagaatttaccaaaataatgcaaaatactgaccctcactccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagac

SEQ ID NO: 1239 - DNA, 483 bp, Homo sapien
ctgccaggctgaaaagaagcctcagctcccacaccgccctcctcaccgcccttcctcgggagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgat

SEQ ID NO: 1240 - DNA, 358 bp, Homo sapien
cctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcratgcctttmtsatamstgaccacactgasggcgaattmcagcacactggcggccgttactagtggatccgagctcggtaccaagcttggcgtaatcatggtcatagctg

SEQ ID NO: 1241 - DNA, 194 bp, Homo sapien
ccaaaggttcgtaatgccatctctgcaccaatctcctcccccatagcaataagggcaatccccagaacagccactccctgatgtgctcccatgtcagcaggggcttccttcttgtccttgtctttcttttccttcttgtctttgtcttcctccttctctttggagtcaaagtgttcgctacaaatgtggagcag

SEQ ID NO: 1242 - DNA, 316 bp, Homo sapien
ccttgttctcactgccctctaagggaacttggtcactcggcacttttaagcctcagtttctccagttcaataataaggacaagagcttttcccatgcattctctttccccgggaaagttgactgaggtgaccagtaatagaattgaaaagggagagtgtcttcagtgcaatgtggcatcctggattgggtcttggaacaaaaacaggacattagtgggaaaattggaaatctgaaaaaagtctgaattttagttaatataccaatttcagtctcttggttttgacagatgtaccatggtgatgtaagatgttgacc

SEQ ID NO: 1243 - DNA, 275 bp, Homo sapien
aaaagggtgatgaaagtattatgtataatattataatggtaaatatgtgatatgaatttgttgaaatcaacagaatatacagcataaagggttaattccaattcacaaaaatataaataaataggagattaggaattccaggatagaatgcagacaatatagaaaatatctaatgtcattacaaatgtatgaaatcagaagaggtgccaagtgacctcagaaatagtgtagtcaataaaagaataaagaaagtgcacgtcagaactgtaccccag

SEQ ID NO: 1244 - DNA, 235 bp, Homo sapien
ctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtcttt

SEQ ID NO: 1245 - DNA, 640 bp, Homo sapien
  misc_feature (1)...(640): n = A,T,C or G
ctgatgatgttccacaaaagagcaaaacatacacaatctggttccactctacagaaatcctggaactggactacaaagggaatagacagggtgtggcaggagggggttcctcacggttggagtgcgaggttagggacaggaatagaaggyaggtaataaacattcatgtggtattaacagggcagatgtgtcaatrtatttscaagtttagcataatataggtataaaaattaaataaaaatagtttakatgtgtgtgtatatatgggttaatacacaacacatacctcctagagtcattacctgagaggttctacaagaaaagacagcaaattaacaaaaaatacacccagaatcaagatttgagttttggttcctttcatagcagaatggtatgcaacatttcttggaaaaatggctaatcctagggcttggaaagagaatataggagtaaagtctacaatttctcatggtacccagaaaataagaaagggttccaaaatgaagaatcgctccttttgcaaaccttatggtaacaaatataatatttataaaaagtgaattangtaatatgttaatggagaaataaacatcattatgaaatgctatcttaacaaaaaatargagaaaatwttagtttt

SEQ ID NO: 1246 - DNA, 509 bp, Homo sapien
aaactttcaaagaatcacttttaggcttacaaaaataaatatttgtcaaaatgttcaataaatattacataaaactagcagcaaaaagtatctagaaatctgtcgtgtgcaaatagttttcttcccaactatcattcccatggtcccaaataaattttagaatctagtcccatccccttcctagacaagctgcgttcaacaatctccaagagacaaagtaagattggaagtttaaggacacgcacacaagacatatatataaaattctctgaatgtgcaataaaagaagtactttgtaaaaagttatgggcaaaatgtacaagggcctaaacctagactaattgaaatagcaccataacaaatgacctcaatactgtcaagtgcacctacttaataaaagttttagaacaaggcacaatacacttgaaaatctattgcactttaggaaatttttgccgtcttcctatgccactgtaaaaagatggagcgttttgatcaccgcattctgg

SEQ ID NO: 1247 - DNA, 310 bp, Homo sapien
catatgtggaactattcttggaaagtctacaaagtgaaatctatcgagttatttctcatttgcaaagtgatcctttgagtcatttctcataatctataatctgaatgttaatactgatatttttaaaagccctacatcccaacagaccaggccatctagatatttcagcgtggtgtctcaggatgagtaaacaaacagctaaaaatatatgacttatgtaaactagagttacaggagttactagcttttctgaaagggatatattctaagtattttttcttaaaaaaaaaaaaargggggggggggggtt

SEQ ID NO: 1248 - DNA, 640 bp, Homo sapien
  misc_feature (1)...(640): n = A,T,C or G
aaagatataaaactatggagaaaactgctaaagggtatccctgacctttatgatgatgcagctattttcgaggccaaaaaatcattttactgggcaagaaaaacatctcattcctttgtcgtgaatatccttgctcaggctctttatgaattattttctgccacagatgattccctgcatcaactaagaaaagcctgttttctttatttcaaacttggtggcgaatgtgttgcgggtcctgttgggctgctttctgtattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagtttttggnatataaatatgtaaatacatgctttaattgcaattt

SEQ ID NO: 1249 - DNA, 1108 bp, Homo sapien
  misc_feature (1)...(1108): n = A,T,C or G
caaaataaatttcaattcaatgaaaagtaaataacttagggatctataaatgacactgcaatgtatcttgttccatttttaacaggaagtccttcatgcaaatgtgtgagtctcccaggatgcatgaagctccagccttttcgtggtgactcaatagagcaattgtaccttacaaatktgcaaccacctccctgaaagtcttctcccacgttattaagtgcaatgyttatggtaaatgtagaagcatcatgatgaggacgaagagaacgctgtcgttcaggggagtattttactacaaaattcagtagtgcaaatcccttcgtataatagcctgcaaagaccttcagtgtaactggtgcaatgaactcccggataaaatgaagccatacattctccagatcaacttgcttcatgtggatatcatcagttgggacattttcataaccaccagatatacggctatcatgatgtttttccccagaccatttgccgtaatgttccatttcttctaccaattcatcacaggnctttttcagaaaatatggggaaccmaaaagacatctggacagggctgttcaamctatattttcagtgaaaatctttgaataatccmcggtttatatacttttccttccagtccacaggattttcaaaaatctgccagaggtcattgttataatgggaagtattgtaattagcagtggataatagccttccaaattcatgtctattagaaatgtacataaatacaccctttggggggctgagcatttggaatgtttccggagtaggggagtctttttccctttgtaaagtcatttctctagcatttcggcaaagagccatatcaggatccagtttatcacgaacaaaatagctcctttcattcatctctgatcggagtgtctttcctttaattaagtacacattagccatatatgggacattccatactcctactctattcccttgaacaatatccacataatcttcagatcgtgcatagtatccatcaggactcaatgctccccagaaattggaccacagctttccatgacgagttacaagaggagcaatgatctttctgttttgttcaatcaaaattttt

SEQ ID NO: 1250 - DNA, 567 bp, Homo sapien
ctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaactaaaaa

SEQ ID NO: 1251 - DNA, 655 bp, Homo sapien
  misc_feature (1)...(655): n = A,T,C or G
gaaagaaaccaatttaatgccaccaaacataagcctgctatacctgggaaacaaaaaatctcacacctaaattctagcagagtaaacgattccaactagaatgtactgtatatccatatggcacatttatgactttgtaatatgtaattcataatacaggnttaaggtgtgtggnatggagctaggaaaaccnaaggagnaggaaattatnnaaaagaactgnaggtnaagtataaagtcatatgcctgatttcctcaaaccttttggttttcctcatggcttctggctttatatttttatcacaaaccaagatctaacagggntctttctagaggattattagataagtaacacttgatcattaagcacggatcatgccactcattcatgggtgntctatgttccatgaactctaatagcccaacttatacatggcactccaaggggatgcttcagccagaaagtaaagggctgaaaaagtagaacaatacaaaagccctcgtgtggggggaactgngggctcactcttacttggccttcattcnaaacaggttgggnctttcntgcgangatctctcagggnggtaaaaactttntggntttcaacanaanaggtttggntgaatgattactcggcngacacctaagggatcc

SEQ ID NO: 1252 - DNA, 672 bp, Homo sapien
  misc_feature (1)...(672): n = A,T,C or G
aaantgcaaaaacccagaagaccaataattctgaaacttggcatgagtgtgcccagtcagcagcttgcaaagagaggatgtgtcagttactacaattgctgtactcctttagctgagtccttcaactttctccttcttgccagtaaatactacgttgtaattcatatgactgagatcttagtatcacaggatttttagctcccatgcctccttcaaaattgtttacatggatttgtttctattctctgtaggccatattccaaacacattcacttctaaatccaacacaagtgaaggaccagccaggatgaaacacttcagcaatcattttgttaaaaataacatcctggtcatcaagctaagcataagcacctcttgtataacaattcatcttaaaagcttaaagtacaataataaaaataactgcctgaaaactggaaatgaaatacaacagaaaaactgaagcattagtaatttttgcaagtaacccaggtacagtacatttgatttcatagagggtgttttctgatgtttaaggagagggtagaaggggtaggaaaacttggcaaggaagatggaaacagcacaaccagttattttgcttttaataaagtaaatgtaatgacaggagtagggaggtgacaaacacatcnatatatatttttcttatgg

SEQ ID NO: 1253 - DNA, 644 bp, Homo sapien
  misc_feature (1)...(644): n = A,T,C or G
ccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaatatggggtgaagatctaagacatttaatagtatcgagaagtacacagacaccactaataatcagacctgattctggaaaccctcttgacactgtgttaaaggttttggagattttaggtaagaagtttcctgttactgagaactcaaagggttacaagttgctgcccaccttatcttagagttattcaaggggatggagtagatattaataccttacaaagagattgnaganggcatgaaacaaaaaatgyggactattgaaaatattgccttcgttctggcggaggtttgctc

SEQ ID NO: 1254 - DNA, 438 bp, Homo sapien
aaagggcatttgaggggaggattattgctatgaatgaaaaaaatattttagcttagactaagctacctgccttcaaaatagtttagggaccaccaccatattttattttgtttttatttttgaacatttttctaatgatttggagagaaaactatttacaaaaattccacatatcagtgatacaatttcttgctgtcaccaattttttataatagcagagtggcctgttctaagaaggccatattttttaagttatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccatttt

SEQ ID NO: 1255 - DNA, 519 bp, Homo sapien
caagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagcatcttctgagactcacaggagaatatggaatgtgatctacccaatcacagtcagtgtgattattttattccaaatatctaccaaggaatgaccaggagaataagatcctccgatgttcgcaatggtgtggtgtcaggaggctgcctcttagacaatctccagatgtactgtgatgtgagtttgaaaaagagttcctgaagtaccacatctgggagacatgccactagctgagcttcccaaaagtctaccaagagctgaggaattgtatcttcatccttagcacaaagcaccttaaaaacagtaaaaggagcctctatattccagataaatatagcactgataaagcgacag

SEQ ID NO: 1256 - DNA, 178 bp, Homo sapien
ccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaagg

SEQ ID NO: 1257 - DNA, 255 bp, Homo sapien
gggtccacttgctgccccatcattgtatcaccttccttcaatcttttggctgccactctcatgtagggatccacggtgaggaacaaagcttcaagcaggacctctccattttttaagggtgggagctcagatgtcttcaactcaaagtcactattagtaggatagccaacaaagtgcttcttcagggtccatgtcttagtacgaaccatcctgaagctcaggagcccgaaggttccactgcctggggaaggcggc

SEQ ID NO: 1258 - DNA, 630 bp, Homo sapien
aaaactaaaagcatcactgctgaactccagctcagtcttcccattttataatgaggactctgaagtttatagaggtcaaggacttgtccaaagctttagatatgtagtgtctgtgcccttttcctctaagtttctcctagagaatgtgggggctcaggaacagagaaaataaggtgcaaaaagtagaaatgggtggtgtttctcaaagtgtggtccatctgcatcctagtgactggggtgcttgttaaaatgcagattgctgggccttatcccaatctgaccaaatcatctcaggatctaccttttgaacaaacttgcctaggtcaaattcactcttgtggaagtttaagtacttcagaaacaagacagccacagaaggtgcacctgctaatttggtggcttccagtgcctcatctgtaacttctggtgaaatcctgagatgtcttactttacattgtttacatcccataacattccaacatttagaaattcactcgagcttatttttcttacttgtttagcactaaatgaaaatagctccctgaagttaaggagtttatatacagtaattcatgcaagtgtgtaaattaaacagatgactttcccccctaatatctaatgcacagcaag

SEQ ID NO: 1259 - DNA, 159 bp, Homo sapien; identical to SEQ ID NO: 235

SEQ ID NO: 1260 - DNA, 115 bp, Homo sapien
aaaaatactataatttcaaaacttccaaatttcaacagatgccagtgttctctccttttttcatatgggaaaatttctttcaaaattatttgacgcttggacaaaaattccacag

SEQ ID NO: 1261 - DNA, 280 bp, Homo sapien
aaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcctcaaaatgtttatacgtggaaacacacctacatgaaaagcagaaatcggttgctgttttgcttctttttccctcttatttttgtattgtggtcatttcctatgcaaataatggagcaaacag

SEQ ID NO: 1262 - DNA, 144 bp, Homo sapien
aaattatttgatgagttccacttgtatcatggcctacccgaggagaagaggagtttgttaactgggcctatgtagtagcctcatttaccatcgwttgtattactgaccacatatgcttgtcactgggaaagaagcctgtttcag

SEQ ID NO: 1263 - DNA, 487 bp, Homo sapien
aaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagtggtgcagcattcctacctagtgtcataaaagcaaaatacttacatagctttcttaaaatataggaatgacattacatttttaggagaaagtaagttgctttgcaccgcctacttaattcttttccatatattgtgatacaaacttttgaatatggaatcttactatttgaatagaaatgtgtatgtataatatacatacatacataagcatatatgtgtgtgtgtgtgtgtatatatatatatatgcatgctgtgaaacttgactacacaacataaatcacttttt

SEQ ID NO: 1264 - DNA, 250 bp, Homo sapien
ctgcttcaacagagtggcagcaaccaagctggagtccaagccccctgataaaaggcagccaatccttctgtctgtcatcaaacgtttctttacagcattattaaaaaggatcctgaggttgttcttcacagtttctatctcaaaacctggaaagagtttctccacattgtcatagagggcgtgcaggggttcatcccgacagtgatgatatttaaccatttccacggatgcaactttgccatttggcttt

SEQ ID NO: 1265 - DNA, 394 bp, Homo sapien
aaatatttgttccaacctttttcgttggtggcatttatggctttggagcactgtcaggcccatgttcattaccgtgagctcctgtgcatctcctaatttccaaactagcctggaaaacgcctccattgaccatgattggttcatggtcctgtgcatggaacatcatatgttcagggagataaagaactctgatagtggcacctgggtaaaaagtacaatccattatatctggatatcaagatcttttgcagttgaagagaggtattgccacagagaaaattataggagcagaagaaagtcaatgaaagtcaatgatgacactccattaggaaccagaaagatggtatttatttatacatataataggtgtaagagattagaggaagcctgtcac

SEQ ID NO: 1266 - DNA, 229 bp, Homo sapien
ccacagttgtatcatatagcatctctaacatttcatctaggattatctagtatagatcttactatatttggggctatgttgtatacaatgttaacaagaacatatcttctctgcatatatgtgtgaattataaagaaaagcatgagaatgactctaagttcaacaaacatgggtgaatctctatgtgctcccagtgtcctggatgggctccccagcaagccattcctcc

SEQ ID NO: 1267 - DNA, 722 bp, Homo sapien
  misc_feature (1)...(722): n = A,T,C or G
aaatcttatcaactttccaaattttcatactaaaatatattattgtattaatacaaactacagtattatacactacactgtgtaataaataaagaaatataaaaataagacacataaatataaaagttttctaaaactaaaagtacatatgtcagtaagaagggtattaatactgccaggtttgaagacatacagtacaaaaatgttgcacagatctataaactaaaagaaataaaataatactgataggtaaaaatcagctaatgttgttaataaattgggtccataataactaacatttggaaacagttatgagccaaataacaatagcatgtccatgtctgaaatgcaagtacatggataaagcagattagaaaatttccctttcgtttctgtagagaaattctgaaaatcaatcaacataaaatcaataccgaggaattgaaggatgaaatgtcccagtgtttcagtttctctgacagagtcagtggttttaagttttatttgggaattttgatacaagagacaaatcaacaaatgctagttattgtaggccacacattggatgaaggcgggttagagccttgaaaatactgagaaatggcacttacagcacacaggtcttgcttaagggcaaaggagatacaaagcttcatgncatatccttcatatggtaccacatattcaaacaccatcccaacactgatctgatgattttgctg

SEQ ID NO: 1268 - DNA, 407 bp, Homo sapien
gatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggtttttgtttcttttgggtatttcttttttggcacatgtgaatcttgttttgtgtaaaatgaaattactttctcttgttctctgatgatgggttt

SEQ ID NO: 1269 - DNA, 675 bp, Homo sapien
  misc_feature (1)...(675): n = A,T,C or G
ctgaaaaagagtgatcctcaatatcctaactaactggtcctcaactcaagcagagtttcttcactctggcactgtgatcatgaaacttagtagaggggattgtgtgtattttatacaaatttaatacaatgtcttacattgataaaattcttaaagagcaaaactgcattttatttctgcatccacattccaatcatattagaactaagatatttatctatgaagatataaatggtgcagagagactttcatctgtggattgcgttgtttcttagggttcctagcactgatgcctgcacaagcatgtgatatgtgaaataaaatggattcttctatagctaaatgagttccctctggggagagttctggtactgcaatcacaatgccagatggtgtttatgggctatttgtgtaagtaagtggtaagatgctatgaagtaagtgtgtttgttttcatcttatggaaactcttgatgcatgtgcttttgtatggaataaattttggtgcaatatgatgtcattcaactttgcattgaattgaaattttgggtggatttatatgtattataccctgtcacgcttctagttgcttcaaccatttataccattttgnacatatttttacttgnaaatatttacctgncccggccggccgtcgaaagggcgaaattcaac

SEQ ID NO: 1270 - DNA, 268 bp, Homo sapien
ccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactgg

SEQ ID NO: 1271 - DNA, 307 bp, Homo sapien
cctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggagg

SEQ ID NO: 1272 - DNA, 798 bp, Homo sapien
  misc_feature (1)...(798): n = A,T,C or G
ccattgctagaaattgaatcacaaataatagctaataatttttcatttttcaaaaaagatcatttggatagcagctatgtataaaatggaaaataaaaaattattctattttgcatgaatagttcagactttcccataccacagccaagcagtaactaaaattaggatcttaattttcaatgataaaaggtctaaggttcatttaattatgctcctttaacactgtctttctagatttttcacccagtattttcaaaatttgggaatgtaaacaattgatatatttattgtatgttggctagcagttcatccttctgcaaaatatgcattcagagaaatgtgaagcttgttttaatgaagacttaaaccatttgtgtcatttgtgttttcatattcaaatacaccaaattaaaattctgaacctatatttttcatcattaacttcctaatataccagaacatatacctttttcatgtaaagttggcaatgggatatggcagttttatttttgaaaaatatgtaacatgactttaatatttttatagttttcagaattagaaacataggaagggaaaatgttttaattagataagtcaactttttatgggctgnagtggngactataatagcaaattataaagcattattaaatggttataataattttaatattacctcattatgaattaactaaaataaagnggagtgatatttttaatgggtgntcatactggagctcctgagatatatgatttgctattgactcactggntgattgaataatatattactcgcgg

SEQ ID NO: 1273 - DNA, 664 bp, Homo sapien
  misc_feature (1)...(664): n = A,T,C or G
aaaatataccttttcacaggtagcaagaaatagtacatgtaataagtctttatgactggaatgatccagaaatatcacaaagcatgagtaaacacatatataaaagtagctcatcatttccaaaagttaacctttagcctttgtgtaaaataaatggtgccaacaatctttataatgtagcaagctttccctgtttaatatccaaaaaatggagggtggggaggttgaagaaaaataagaaaagttagcaaataagatagtgaaaagaccaatgcagagaaaagtttatgtaatcaaatcttgctttgtctccacattatcacattttaagtggataaatttatgtaaacagaaaaagatgtccacaaaaccatatctatagatgtcatttggaagcatcaagaaattgataagtatgtggtgaattaaaattacttttataatgttttgctttcattaatgtttgttattgcaaaaatgtaagatttcctacaattttgtcttcaaatcccaatctagcccttcaaacttttatccaggttctccagaatatttggagtctttgttatcaaagcacaaggaaagctggcattcattatcagacttcgctgctttacaatganttcaaatcatttcatgatacaaataaagtgcctctgactgg

SEQ ID NO: 1274 - DNA, 153 bp, Homo sapien; identical to SEQ ID NO: 239

SEQ ID NO: 1275 - DNA, 504 bp, Homo sapien
aaaattctgataaaaatttactcaattacattttatacattaatatttagtgaatttgtccaaaaaggctatgtttaatttatgtgtaaaaataacaaaagatgtatcagtcagtctctgggcaataagaaaggaagaaagccttgctagaaataataaataatctcacgcaaaaggccaggtgacataagaatactacaataatcaatatgttttctttgtatttacaataaaatccatctgttaacactgtgatagaaaaaataatcagtccacatcatgtaataaaaacaggctttgaggatgattatacctcttataataaaaacatacaaggatttctcacagctaaagtacttttcaactttgacaactaatgacagtcatgggtgaaggtaaaactgacagagtactttagatcagctatgtcctacagtcaaggaatcaagggcattacccatttaccaagcagcaaaaagcactttcatttttccagaactattt

SEQ ID NO: 1276 - DNA, 533 bp, Homo sapien
gacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaattt

SEQ ID NO: 1277 - DNA, 78 bp, Homo sapien
ccacaggaagttgcaaaaattagatggactctgtgtagctagccactcttgagtgtcaggtctgcatatgtgagtttt

SEQ ID NO: 1278 - DNA, 560 bp, Homo sapien
aaatatctaaaacaatggcccactgaagaaaggaacaattaactctttaattaattccttaggataagtacccagaaatttaacagctagggcagacttctaatacaataccgaaagtccttccaaaaaccaagtggttgccaacttatgtcccttagcattataacattcttgagccaatagtgtaaaaatacgctgacaattttataggcaaacattactcaaggtatcttactttccacttattactaaagtaattaacccctaaatagatgctcctcaacagtgggactacatcctggtaaacctatcataagttgaaactatcaagttgaaatgcatttagtacccggataaacctatcataaagttgaaaatttgtaaattgaaccagtgtaaatcagaggccatcttacttcatactcatgaagcaactatagtgggatatttttcaacttacgagatagcctaggcttgttgaaacactgtcctaatttactggctctctggtaattaagtcataaatggtcaaacatcaaattctagaaaagcatatattt

SEQ ID NO: 1279 - DNA, 580 bp, Homo sapien
aaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacatttt

SEQ ID NO: 1280 - DNA, 307 bp, Homo sapien
aaacacatacgaagaaatcaactgtgattatgaagtggcagccagctaaatatgtcttgtatttgctctcttcctttttttgcctaactcatcctttacttccattcctgcttccatggtaatgcaggctcaaataaattactaggatacaagattacttcaagcctcttttctgtggaactcataatatgataagcatttgttacaagattgcctgtagttgtttaggggataaattatattagggaaagaaagtctttctttagttggttaaattttctattataattgggtactaaatttattt

SEQ ID NO: 1281 - DNA, 235 bp, Homo sapien
aaaatattttaatagttacatagcactttagtttgctgatttaatttatcccaagggacaaggatgttaatgagaaaactgactagatttcagatcacagattttaagagaacaaggatctcaaaaccaaataccctctgcttaaagtgttttttgtgtttttcactactgaaaatgtttagagattgacttacctattgctgatactcaaaacatctgatatcttaatattttt

SEQ ID NO: 1282 - DNA, 230 bp, Homo sapien
  misc_feature (1)...(230): n = A,T,C or G
aaagaatttctttataagattkactgtmtaagattaatagcattcgaagatccccagacttcatagaatactcagggaaagcatttacctcsgtcgctgaccackctargggcsawggccagcacactggcggccgttactagtggatccgagctcggtaccaagcttggcgtaatcatggtcatagctgattnctgtgaggtaccagattgcctgtagttgtttagggg

SEQ ID NO: 1283 - DNA, 638 bp, Homo sapien
aaacacaacagctataaacctgaacacatatgctatcatcatgccataagactaaaacaattatatttagcgacaagtagaaaggattaaatagtcaaatacaagaatgaaaaacgcagtacatagtgtcgcgaactcaaatcggcatttagatagatccagtggtttaaacggcacgtttttgcttataaaaaaagtgcaaaaaagatgtggtttacaagttaaagctacagaatccctttttgctgtaattgcaccagttttaaagcctctggacagagcagtatttcgtttaaaactttgttyttcttaaaagcttacagtgtttggctaattctcctcycctttttacaagacgggggccggagggtggacactggtggcaggttaagggatactgtcactttaagaagcctgcagattgaagtgtaaacatggagaaattaggggctgattttttaaactgtgtgagatattaaccagccgccctgttataaaatcaggaaatccaaacagcgatttacaccgattaacaccccctttatatattttttacaaaaatacactgagaaaataatcaaacgttttcatctctcttgtctttttttgttttttaaaagtgtcaaaagtctacattt

SEQ ID NO: 1284 - DNA, 745 bp, Homo sapien
  misc_feature (1)...(745): n = A,T,C or G
cgacggtatcgataagcttgatatcgaattcctgcagcccgggggatccactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaanggggttaaactttaaaaaaaaaaaaaaaaa

SEQ ID NO: 1285 - DNA, 190 bp, Homo sapien
cgacggtatcgataagcttgatatcgaattcctgcagcccgggggatccactagttattaatagtaatcaattacggggtcattagttcatagcccatatatggagttccgcgttacataacttacggtaaatggccgccaccgcggtggagctccagcttttgttccctttagtgagggttaattgcgc

SEQ ID NO: 1286 - DNA, 153 bp, Homo sapien
ctgcatctttctacaattctaccagcaatatatgagggttacaatttctcyccatctttgtgaacgcttgttagagtctgtcctcttttcttccattctgtgggttggctttttactttctaaatggtagaaccttcaaagcacaaaggtttt

SEQ ID NO: 1287 - DNA, 232 bp, Homo sapien
aaaaacacaaaacactagaacagttgctatgaaattactgataatgatccctttaataaactgcaattaaccactaatatagaaattcaatttaagcaagaagttttatatattatactttacagaaaaaaataattttgaaaaagtaatgmcaaacagagatcaaacatttagggcattagttactgcattctctttttagaatatacattaagtaacactagtaaaattt

SEQ ID NO: 1288 - DNA, 90 bp, Homo sapien
aaacttagtgactatttagttcaattgytcatccattttttatttgcttttataattgcctccttgttttggtatattgtaaaataattt

SEQ ID NO: 1289 - DNA, 670 bp, Homo sapien
aaatcacaaagtaaggcaccattggattaaacatttctcctggcttttactaagtaaaatgcatagtgaaataaatactgaacactgagttttaatactgtaatacatttcaatataaaataagaggtgaatgttaaaatactgtattacatgttgaatacatttatctgaaaatgttataaaaaaacacacatgtaagctctgatttcagggaagaaaaattcatttttgtaattttccatagtttaagattttaccacagaacttattcatagttttagatgcaattaggttgcaaactttcaaagaaagggtgtaggtgtattaatgaaacagtcacttaaacactacattctaaaacaatctattctggatgaatggcaactttgagctatcaccctgtttcagatttagaacggtacctgccaagttcagatatgcaaaggaattgtccaattcttactaccccttataaaattcagactcactttctctgagtcagacttttctccgtcatattttctaggaagggcaaattccatcttttgtgaaatgggtcattaggctttatcatagggatgtttttcactgttgaaatcagataaaagaatcccaaataaatgatgctgctaaattaccaaactgctagagattaaaaaaattttttttt

SEQ ID NO: 1290 - DNA, 352 bp, Homo sapien
aaacaatgctacacccatttttggcaaagtgctgtattgttcagtctgtgtacaaaactgaccatctatgaaccaatcagtataaaaaatttctataaaaacaaaatttagacagtggctcaagaaaacaagctgccatttatgcatagattgatgtacagtaacctaaccaaatgtcccttttgaattttcaagttactgaaaaaaaatgtgtcgagaaacacattaagaaggcacatgtacagtctacaatactcttcagtctccctaactcatgccctgcccctataaaggaaatatgttcacaattttacttgagaaaaaaaaacaaagccacttaaaaaaaaaaaaa

SEQ ID NO: 1291 - DNA, 99 bp, Homo sapien
aaaaattatttaaggtaatggtgttacgaatggtttaaaaatgtctggtgacttgcttatttttaagtgatcaccattaagtcagaaaaatgtattttt

SEQ ID NO: 1292 - DNA, 295 bp, Homo sapien
aaatatacctttatttctcaaactcaaagctttatcaagttctaacacattttgcattgacaagtgattttatctgcatcaagtaaggttagtgaccaccacgaaagaggaatccccagacctcctaggcactaagaaatatttcaaaggctatgcaaatatagaacaaaaagctttcaatttagtctaattggtatctatttttcatctatattaatttggaaataagttgctaccttagaaaaattacatttttatccattaaaataaaacaccagataggttgagttttttt

SEQ ID NO: 1293 - DNA, 256 bp, Homo sapien
agattcacttcaaagtgaaaatgacaacacatctcaagaaactcaaagaatcatactgtcaaagacagggtgttccaatgaattcactcaggtttctctttgagggtcagagaattgctgataatcatactccaaaggaactgggaatggaggaagaagatgtgattgaagtttatcaggaacaaacggggggtcattcaacagtttagatgttctttttattttttttcttttccctcaatccttttttattttt

SEQ ID NO: 1294 - DNA, 90 bp, Homo sapien
aaaatacttagctttattaaagacatggtactaaaaataacagattccaacatttgctctatttctacttatatatcataaataagacag

SEQ ID NO: 1295 - DNA, 519 bp, Homo sapien
ctgtcgctttatcagtgctatatttatctggaatatagaggctccttttactgtttttaaggtgctttgtgctaaggatgaagatacaattcctcagctcttggtagacttttgggaagctcagctagtggcatgtctcccagatgtggtacttcaggaactctttttcaaactcacatcacagtacatctggagattgtctaagaggcagcctcctgacaccacaccattgcgaacatcggaggatcttattctcctggtcattccttggtagatatttggaataaaataatcacactgactgtgattgggtagatcacattccatattctcctgtgagtctcagaagatgcttcattttgtagaacggtgtaagtggtttccattccagcatgaatgtggtcggtcacatggcagtggagtaaccaaattccaggtgttcttggaaacatttctagggtttggtatgttccagggaaaatgtcaaagacatcagaactataaactcccctgtgcttg

SEQ ID NO: 1296 - DNA, 419 bp, Homo sapien
aaagcaaacagcagaaaccagaagcttctgaccctctaacatgtattactgtccaacccaccatgagaagtatgttcacttggtgacaacaaagagactccgtatcatatgtatgttaatgaccagattgttcatatgggatttttcttaacagattatcaggttgagaatgattctttttctccaagggcaagaaaaagctggctaaatgctagttaattaaatccattctcaattttgaactgtagagaagaacctgacttgaatgagattttctaaaggaagacatttcttgctcaacctcaggtataattagattataaggaatctcacgtccagaattttatctgctgattgttagtatggtaggtaattggccttaggacactatttctactagaaccctttacattattttt

SEQ ID NO: 1297 - DNA, 199 bp, Homo sapien
caggtctgaagattttacatgcagataccagataccttaacttgtatttctttagtcatcttttggcttggaagtttcctctgttgtctttgctgaatccttcgctttacctccattcttaggtgctttggagctggaagcagccttcttgcacttatcctttgctgtgttctgtgaggtttctgtagtggagggacag

SEQ ID NO: 1298 - DNA, 484 bp, Homo sapien
  misc_feature (1)...(484): n = A,T,C or G
aaatacacttgaaaagtaaaatgtttttctagcttttccctcagggcgtaacaccacaccattcataacaatgctattttccaaaggtttcaattagatttcctcagaagcatacctgaactgttaatcattacaactcctttgtgaaacatgggactggttgattacccagtgtaatcactggctgaaacctcagcacactgtttttcaccccagtggaggcaggttttcacctcccctctagctgtacccctctcttaatgcccatattagagaactgtgatcttctttctccactagaaatgttcactttcatcaggtaagggataaaacaaaaacaagagacagaagatcttaaaaaaaaaaatagtaatagggcaagtaaactcagtgaggttagaggaatttgtttggggggcattctatgttgttagytncatatcatgttcagtttgntggttctaganccctctgaaatgcatta

SEQ ID NO: 1299 - DNA, 419 bp, Homo sapien
aaagtccatctttgcaaattatacgttgctataaatacattgtgtatttggcattatgtgaatttgtttaatccagtgtcaattgtctaatggtctaaagtgtcccattgaagttataatctggatgaactgaacaataagagaagttttcttcattagcccaattgtttatcactcaattcctactcctgcccatggtttcttccaccttcctctggagaacataaagagattctagatctctgtataaggtggtttgctttagcttgaaatcatcagtgaggattatacatgggcaatgtccagaaatcacattattgctcatagaccgtgtagtcttgatctaacggataactgtacattgtcttcactaagaagctagggtggttgtccttgatattgggacattgtagacttgg

SEQ ID NO: 1300 - DNA, 182 bp, Homo sapien
  misc_feature (1)...(182): n = A,T,C or G
ccntngaattgtgtgcatagggaagcactcacccaatgagactttctccaatgtggactctgtgtgtcagggaatgaatgtagaaaaattcactttggagggttatcakctcaactagtaagaagcattaatattattaaagtgaagaaactgcagagaaaattacagaacaaaactgtagg

SEQ ID NO: 1301 - DNA, 312 bp, Homo sapien
aaagtttttatctctgctgaggcttcacatctgtttgctcaattttatttttatttcaatccttgagcatgtttataatatagtagtatccccttattgtggctttactttcctcactttcagtcacccacagtcaaaaaatatgaaatataaaactccagaagtaaacagtttataaattttaagtcacactttgttctgaggaatgtgatgcaacctcccgccattctgctgtatccagttcaggatgtgacatacccctttgctcagcagatacacaattcctgcttcctgctcattagacatttgcag

SEQ ID NO: 1302 - DNA, 109 bp, Homo sapien
attcttagattatatgtgtccatctttgcagctttctgagagtaattttatttgttgtcttctgaaatgtacatgtatacatgtacctactgagtgctatgtgattttt

SEQ ID NO: 1303 - DNA, 330 bp, Homo sapien
ccagagttacttggatcagcatttaggaaagtaaaatatagtggaagtaaaactgactcatccaactagacattctacagaaagaaaaatgcattattgacgaactggctacagtaccatgcctctcagccagcccgtgtgtataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacattttt

SEQ ID NO: 1304 - DNA, 170 bp, Homo sapien
ccactgtagtctgcatatccctgtccatatccatagttcccatagttatacccagtataatcatatccgccatagccactatagttttgatcaccaccataggcactattgtaatttccatatccttgatcataatagttattaaatccttggttccagttttggccctg

SEQ ID NO: 1305 - DNA, 468 bp, Homo sapien
aaaaataaatatttatactccagcttttgtgtatttggtgtacatcaccacttatgcaaatcaaggatcagaaaactggaggttagccatctccattatttccttttgcacattgggtacagtgggtggcattagtatgcactagctgcaaagtcacagcaccttatggaaataagtatgtttattataataaaaaaaagttaagctgcatctctgtagattatttactttgcagactgtaaagctgccctatcttttccagcagaatttactcttccattcttaattcttttttgaaatatcttaaataatttaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcag

SEQ ID NO: 1306 - DNA, 326 bp, Homo sapien
tggtaaagaactacctgttaatgcacaaaactatgtgcgatttattgaagatgagcttcaaattccagttaagtggattggtgttggtaaatccagagaatctatgattcaactcttttaatgattgccagtaatgcaagaaacactccttgagagggaggggaaaagactttcttaaatatttcatttatgacctgcaaattcaagaataaagacactgaagtaagtttgaagccctacagytgtttccagtcttttcagatggatgcctactgtggagattaactttggcatattccagtgtcagctttctttagctggaattg

SEQ ID NO: 1307 - DNA, 614 bp, Homo sapien
  misc_feature (1)...(614): n = A,T,C or G
aaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtacttcagactttttaattttatatatatatacattttttttccttctgcaatacatttgaaaacttgtttgggagactctgcattttttattgcggnttttttgttattgttggtttatacaagcatgcgttgcacttcttttttgggagatgcgygtytgytgatgttctatgttttgttttgagtgtaggctgactgttttataatttggggagttctgcatttgatccgcatcccctgtggnttctaaaggggatggncctcagnaactgttgcatggatcctgtgtttgcaactggggaggacagaaactgggggtgatagccagtcctgccttaagaacatttgatgcaaagaatgggaccctgccccggggccgggncccctccgaaangggggggaaaatcccangcacc

SEQ ID NO: 1308 - DNA, 304 bp, Homo sapien
ctgtcttttggaggacgtacgtaataaggttttaatttagtaaaccaatcctatgcatagtttcagcactagccaaacctcaccaactcctagttctagaaaaacaggcacttggcagccttgtgatgtcatacagagaagtcacaggcagtacctgagggtctgtaggttgcacactttggtaccagataactttttttttctttataagaaagcctgagtactccacactgcacaataactcctcccagggttttaactttgttttattttcaaaaccaggtccaatgagctttctgagcag

SEQ ID NO: 1309 - DNA, 289 bp, Homo sapien
gggatttccaattaacagtattaccagataaatattcttggtccaagcagaaaatatcaacaaaaagagccttcttctcctgtaaatcttaaatgcctacatcactctttatgatacatggatcatcttatgtggatacttaaatttttcatgtctgcttcttttgcctctcccaactatactatgaggaaattcggaacaaagacatttttgtaatatttcttatctccttcacacctagtatagagctgattttacaaaggcatttaagagatatttgaattgattt

SEQ ID NO: 1310 - DNA, 534 bp, Homo sapien
  misc_feature (1)...(534): n = A,T,C or G
tgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagytttgacacctagattatagtcttagtaatagcatccactggaaaaggtgaaaatgttttattcagcatttaacttacatttgtactttagagtatttttgtataaaatccatagatttattttacatttagagtatttacactattgataaagtttgtaaataattttctaagacagnttttatatangctacagggtgccctgattttcttattgaatttggttagactag

SEQ ID NO: 1311 - DNA, 114 bp, Homo sapien
aaaatttgtaggagttgtagactacctaaatttttaagttatggyatttggtcataggttgactgggtaggtaaagaaggaaacagacaagaaaatggcttcttgaggtggcag

SEQ ID NO: 1312 - DNA, 95 bp, Homo sapien
gggcgggtaaaggtaggccgcgagagcgaggttaggagaggataggaggccgcagtactgctcacacgctccgctcttctcccactctcgactct

SEQ ID NO: 1313 - DNA, 519 bp, Homo sapien
aaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatgggctgaatacttttttttt

SEQ ID NO: 1314 - DNA, 518 bp, Homo sapien
  misc_feature (1)...(518): n = A,T,C or G
ccatggtgggtgaagacgctgatctgccctgtcacctggggttttttatgagtgcagagaccagggagctgaggaaacccgagytccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagnacttgtgttatttccaagatggngacttctacgaaaaagccctggtggagctgaaggttgcaggtgagcctccaggttttgntctgagaacacttctctgtaggatctanagcagatgcagagtccctcttccaaaagtactgcagacactcctggctgctcactagcaatngtctgcactgcctcccaactnagcttctctgcaacccttaagaaagacacattctttctttagaaagaattcctgctgnaccttacatgccgaagtaaa

SEQ ID NO: 1315 - DNA, 360 bp, Homo sapien
tctgtgcatccaatttattatagwtttgtaagtaacaatatgtaatcaaacttctaggtgacttgagagtggaacctcctatatcattatttagcaccgtttgtgacagtaaccatttcagtgtattgtttattataccacttatatcaacttatttttcaccagkataawatcttratttytacgacctatcattctgaatcaagmacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactattt

SEQ ID NO: 1316 - DNA, 277 bp, Homo sapien
aaaaaacacgtttgttattaccaaawagagacggctttaggtaaaaataataaaaaccctttgcttgyattacytatgcaratagttstatttatctggwcwacgggytaaaggyacagyactataggwctctggcttgagtmtttacgttcatttcttattgctggaatktcatatttcttcttgttggatgactaaaccggatgatggtagagatggtaagccggcatttactcagccccgccctgctcagcctcgggagcggacgaattctcag

SEQ ID NO: 1317 - DNA, 716 bp, Homo sapien
aaaatgttctcttgagactagtaggcatagaagaaagcagaaggaaaataaatagaaagaaggtcttctaccttcatggctattcaggctcaggagggtggagagaaaaagaaggaggacaaatgaacaagacagatgagggagacatcctctctgatataagatacagtcctctctggtggatggagtccaatttgtgtaacttcctatgtattttcctagataggaccaccactatttgagaaaatatctcactggtaacctaaagccaaggataataaaccttgatatacttaacattcaatttctttccagcaatgtgataaataaatctatcttgtgtttctcttgcagattgtaaaagcattagaacatttacatagtaagctgtctgtcattcacagaggtaagcatccatgagctgccttggctgttcctttgataaagttcatctctttcacctggagtccgtctctacccccagtcccccatgggtggaagtagaattgactcaggcaagagaactaaggggctttcctttgagattggatagcaaaccatataagtagtattccttatcatggctgaggacataagaagaagacgtgatctttgtcttacatccaaattgaatataaacacttggtagcaagcagagctatgagatcatatcattgagaattttagagaatatgataaaaattgatcttgtctgg

SEQ ID NO: 1318 - DNA, 515 bp, Homo sapien
aaagctgtatcatgttgagtaaacctgacctgagccagcggtttaaggcgattttgctcgatgaaggtcaagacgtgaacccggtcattgccgacttggtaaggatacagcgcatctgcaaagtaaccgtcggcgaccctcaccagcagatttaccgtttccgtggtgccgaagacgctctcaacagcgattggatggccgatgcagagcgtcactacctgacccagagctttcgcttcggtccagcagtcgcgcatgtggctaacatcatacttttttacaagggtgaaactcgaaagctgcaagggttaggccccaaaacccaggttaaacgtgcgcttcctgaagacctaccgcatcgcacatacatccatcgcacggttaccggcgtcatagagaacgcgcttagcttggtagcgagcaatccaaagatctattgggtaggtggcatcgacagttattcattgcgcgacctggaagacttgtatctgttcagccgcaaccaaaaccaagcc

SEQ ID NO: 1319 - DNA, 141 bp, Homo sapien
aaatttagtgtctcatttggaaataaactctgggcctattagttgttgagtattttttttttttactacctaaaaaaagatttgttaagagctgaattacaacttagcattacataatataaaacactgtaatgtgtattt

SEQ ID NO: 1320 - DNA, 497 bp, Homo sapien
aaattcagtcctaagaaagaggagtgcttgtcccctaagggtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttccttt

SEQ ID NO: 1321 - DNA, 344 bp, Homo sapien; identical to SEQ ID NO: 1148

SEQ ID NO: 1322 - DNA, 110 bp, Homo sapien
ccaccacatagccagccaggaatcccttgaggaacggggaggacaacagcgagccaccctggcccactccactgttgacttcgtcttctacacgccgctgcaggctttcc

SEQ ID NO: 1323 - DNA, 359 bp, Homo sapien
ccacgctgctggcctgggctggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcagaggtccacagcagcttagacctggagtcatctgttttggtcttagttctgacactttaatgggcttgggaccctggagcaaaagttctcctctgtgaagcgaggatttcaggagcgaggatttcaggactgaggcagcctgtgaagctgtgtaaccgagacacgcttttccttaggtatgccgagcagacag

SEQ ID NO: 1324 - DNA, 258 bp, Homo sapien
caatcacacaaccacaaaaaagatactgtgtgctctcactttccaaaattctgcctggtctmctcctgaggaaagyagtgatatggtagctggtgtggatcccctaaaggaattataagatggartgygargaacattatcttagactataakactgkctgcatrcrgatatgktstcraagattattcctgctgcraataaagakmttgskaaagagcartatasagctatcacagtctattgacccamasatgttt

SEQ ID NO: 1325 - DNA, 534 bp, Homo sapien
ctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcag

SEQ ID NO: 1326 - DNA, 177 bp, Homo sapien
ctgcattatgtgtgtttagaacgagaagttgtttgtacagtatttttctattgaccgcttccgtcttgcctgaaacctgggcattctttccaatagacagaaaatcagagagtcaaatctgatgcgcaatgagttgttctgagaccagtaatccacggtgctgcaatttgggttttt

SEQ ID NO: 1327 - DNA, 266 bp, Homo sapien
aaacttgttttatctaatactgagcactgtttttttgtcaagtatttttttaagaccacataattctttttgtctgctcaaggaaaggatagataaataattggcacacatttgtttctcactgaattttacagtagtaaattaatgttataatgtaccacatggagatgagttggtaagaaatcatctagttccagagcccagggattataaacagtaggtgaaatagatttatgacttacgaaatatgttgtgacaatatattt

SEQ ID NO: 1328 - DNA, 409 bp, Homo sapien
ctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataatcccatagtcaagagcatcacagtctctgcatctggaacttctcctggtctctcag

SEQ ID NO: 1329 - DNA, 136 bp, Homo sapien
ccattttcgcacagtccaccataaaattgaaaagattgaccagagacagatcatggagggcttggcaatctgtactgatgaagccatggaccagaagagaagtgagtcaatgaagagagtttctcttttcacatgg

SEQ ID NO: 1330 - DNA, 311 bp, Homo sapien
ctgctaacagccctaacggtgcaacacaagtacaaactcaggaacctcttcgactgccacgcccttcaccaacagaaggaagacagtggcgccaccacaagtggcagggcacaggggcttctgtgacaacaatatgtccttctagtatacattcattgcaaaggctgccctgaagtttcgtttttggaaataactgttatcatacattttgtatgatgttgcttgtgggcaccatgaagagagcctggctgtaaaggacagagggagctaaaccaacaatgcatggccctgcgtgcccacaagagggagcc

SEQ ID NO: 1331 - DNA, 613 bp, Homo sapien
ctgggccakgagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacaatcaaaaggatcgttttgttttgtttt

SEQ ID NO: 1332 - DNA, 591 bp, Homo sapien
  misc_feature (1)...(591): n = A,T,C or G
ctgagttaanatggtaaagccaatattattttaggaggaaagaggacgaaggccaatgaaccaacatctgcctgctatctggtgcatcacccaaggtgaccaatggctgggcacaaataaacttctcttttgctagccacagagttgctcactgtggcaagcctgagctggtcagaacacctgtgtgtgtgttcctgatacacactaaccacaataagcaagtctgcacacatctctatgagccccatgcaaagacaagacattcccaaagatcagtcactagagtgcaacaacgaaattcaagatttgaccaaaacagaccctgctgcctcctaaattgccaattgcctctcaaaaacttacagaaaaagggacattataagaattcatagagggagagaagaaaaagctgctactcctagtcattagtacaatgtgctgtgttaattagatacctctatataaattagaaaaagtgctttacttgcatgcttcaataaaatgaatactgagtgtcgtagtgttagatctgtacagatataaattttttgcagctatataaaagtgtataagatgggcttttgcatttta

SEQ ID NO: 1333 - DNA, 379 bp, Homo sapien
ctggtacaaaggcgaaagagtggatggcaacagtctaattgtaggatatgtaataggaactcaacaagctaccccagggcccgcatgcagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggctcagaacacaacctacctgtggtgggtaaatggtcagagcctcccagtcagtcccaggctgcag

SEQ ID NO: 1334 - DNA, 384 bp, Homo sapien; identical to SEQ ID NO: 251

SEQ ID NO: 1335 - DNA, 555 bp, Homo sapien
aaattagttgctataaattcatcaatactttttttccctattatatttttggttctattaggatttacttaactgaatcttataacaattcgaggtgaactgtggcaatgaaaaccagaaacagttaatgagatgcttcagctcacagtttgaagtgctgagaacctaagtattttgctgtacggtactgagctgtaccaaaatatgatggtttaggtttatgtgcaagactttgtgttgtagtctagacaaaggggtgggcaagagacatgcaaagctgaagccctgcttgaaaagacccttcaaggaagtaaaatggcaggggcagagtgcagcttaacatgttgctatccctgttgtttttgagttggttttggaatggattcaagttcttacacaatttattttgaatacaagcataatctaggtgatttgagttaatgaacttcttttcatgatgtagggaaagctgaatgtatatatttctaagaagaatttgtttagcagattacaagttggcaaaatagactgttcacagaaactaggcaaaaattt

SEQ ID NO: 1336 - DNA, 505 bp, Homo sapien
cctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaargaaaaataaaaagaaaattaagaatgaaaatactgaaggaagccctcaagaagatggtgtggaactagaagg

SEQ ID NO: 1337 - DNA, 385 bp, Homo sapien
ctggtgctagtcagagctaatgacagaatttcagtttaataaaaagacccccaactgagcacaccatcttgaaaaaagtatacttatcaaacagctttcaatcagttcaagagagacaccttaattggggagaggaagaattgcagagtagtttgtaatcatgccaattccagatcaataactgcatgtctgttctttggtagaaatagcttttgctttatattaagtaatcacatatatattctctctatttggataaggaaaccttcgctttatttgacaatgtataatgatatactcttctaattcacctctgtgtcttcacaataaacatgagtaaaatttagacaagtgatggtaaaggtcaatataattatttattttt

SEQ ID NO: 1338 - DNA, 350 bp, Homo sapien
aaaggtgatattacacaaaacctcgtcttttgttcaactttggatccattggcaattcaatggcctcaatctccccaaactcgccaaagtactccctgatcttttcctcagtggcttcaggattcagacccccaacgaagattttcttcaccgggtccttcttcatagccatggcctttttagggtcaatgacacggccatccagcctgtgctccttctggtctaggaccttctccacactggctgcatctttgaacaggataaacccaaaccctcttgaccgtccagtgttgggatccatttttattgtacagtcaacgacctctccaaatttagtaaaatagtctttt

SEQ ID NO: 1339 - DNA, 443 bp, Homo sapien
ctgctcctctagtaataagttcctggggataatacattaaccaacattggttgaaacatacctgagtaatcatatcaggatgcatgttaagctgataaaacaataagatcccaaaatgcagtagctcaaaaaaagtagaagttaatttatctcctgggggacagctctggttctcaaattttacaggctcagaatcacctgcagggcttgtgaaagtacagattgctgcgctccgcccccagagtttctgatttagtaggtgttaggctgaaccaagaatttgcctttctaacaagctcccaagtgatgctgatgacttgtaggaatggatttacttctaggattagacttcagctcactctgtttgctgaactctttctaatatttcttaagttggtagactcyctgctccaggttctcaacgtgaaggaaggaacccccag

SEQ ID NO: 1340 - DNA, 273 bp, Homo sapien
cctcaggaacaggtaggggcagcagaatagaatagcatccatttcccagagaaagactgcctttacatktcccatgcttttagcacaaagcagcgtctgggccactgttaccagaggtgagtttatacatttacaaaatgcttaaaatctttgggaagcaagaggaagctaaacagaaggtcccatgttaactgaaggcaaattcactcaacctctctagtaagggacccatgggcctacagagtgttccctctacaatgtgcagagtggaaa

SEQ ID NO: 1341 - DNA, 561 bp, Homo sapien
ccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacacccccaccccaacaccgccaagacagcagtcttcytcacccgctgcagccgttccgtcccaaacagagggccacacagataccccacgttctatataaggaggaaaacgggaaagaatataaagttaaaaaaaagcctccggtttccactactgtgtagactcctgcttcttcaagcacctgcagattctgatttttttgttgttgttgttctcctccattgctgttgttgcagggaagtcttacttaaaaaaaaaaaaaaattttgtgagtgactcggtgtaaaaccatgtagttttaacagaaccagagggttgtactattgttt

SEQ ID NO: 1342 - DNA, 159 bp, Homo sapien
aaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaatttt

SEQ ID NO: 1343 - DNA, 76 bp, Homo sapien
aaaatgtaaagccaatctatcaccaaaaatggcataaatgtaaacacaagctaattttataatccactgctatttt

SEQ ID NO: 1344 - DNA, 726 bp, Homo sapien
caaaagcagcctgaatacgcaactcacgccaagagggcagcagctctcctgacatccatgtaagaaggctaacacctaaaccacacgcaggcatcctgaactcagcagctctgatccaaggtactgagtggagacaaagcactcggaggtggcaagatgttcagcaaccaagtaagacacactggcaaggcatcccacccaaaggtgagaagcacaaagcaggcttggagaaacaaacagtcatgccaggtgcagccagacatcctgctataagccctgaccctagtaccccgagttcatcaagtgctctggttttgtgtccataaagcacagagggcactgaccaccccaaaccagaatcccaaggaatccttatggatggcatagggcctcagaactgctgcaggatcattttccttttcaggtcgtggctgaacttgttcatcctgaagagctcactgtcataaaatgcagagaggttgtggatgttgatctgacgagccttatccaccaagtccttmtcagggacctcaatagtgtcctgctgggccccaaagcggttgcgctgatatgtcacstgctctgccactaactgcttcagtatgaagagcaacagctcattgttgtcacgccggaatgaaaggtagcgggcaaaagtcttgcgcatgctgcgcatgacgctgaacttctgtgtgtctatgaagstctccakmatcaygagratgg

SEQ ID NO: 1345 - DNA, 742 bp, Homo sapien
ccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttccaaaggaagtcccatggatgggtttctagaagtctataaatgctctgaaattgtatttttctgtggaaaagcataacttttatctgcttggtcgtgctcaaaaaaagatcatgaatggaatgaattgcattgaattttatgccattgggggcttaatactaaaaggatatggaag

SEQ ID NO: 1346 - DNA, 573 bp, Homo sapien
  misc_feature (1)...(573): n = A,T,C or G
aaatgcattkttaacttacagtattttcaacttacgatgtgtttatcasgaagtaaccccatcataagcagaggagcatctgtattgcgtaatttgactggcacagtttattaggttctgttcagtgwtttccgtcaacaagatgtttattgtgtgagtaaacaagttaagccctgtgacaagctgaataagaatagtctctcctcagcagcttatagtaaacaagggtagtaatccttacattagtggctagactatcaaacgaaatatataacatgtaagaacactaaagacagaattactgtggcatagagatagttagaattgcttcagcctaagagatgaattaggtaatgcaaggaggtgaatatgttggcctgcaatatgaacaaggcagagagctgggagagtaagatgtaagttgctaaggagggatgtgtcttgagtttggaaaccataaagggaaatcataggtaatgctagagtcactgatcttanggagccttgaataacggtgatgactaagggaatctttattttggngggactattggaattaaattggccagaatt

SEQ ID NO: 1347 - DNA, 333 bp, Homo sapien
cctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtgg

SEQ ID NO: 1348 - DNA, 185 bp, Homo sapien
aaaaaagcttgcagcaagaaaatgccagtgtgcaactgggtgactaaagaccaaagaaaaacagttaaaagggacagcttacttgctctctgtctcaggtttaacttctcacctgaaatctctcatagccctaattaaacacaaacaaaagtctcttccatagataggctacttctcagcttcag

SEQ ID NO: 1349 - DNA, 171 bp, Homo sapien
gcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagagg

SEQ ID NO: 1350 - DNA, 400 bp, Homo sapien
ttgtcatatcatatctatgtcacctgtgtattctgagattacacacatacctgccaatatacctgggaaaggttattttatcacagttacacttgagttcttggcaggcaggactgaggaagagtaatttgaaagaagttttacatcctatttagaagaaatcactagtatttccttaaataacaggttacaatagaaagatactgcctggaagttatcctttcactttggttcatttttagtttttctttatgatttacatagctgtttaattcatttgcttatagtacaatcctgccataaagtattaaagcacaagatacctattattccttcaacatctgcatttttcaagttttatactctacatccacagtacgtcagcagttcttgaatgttt

SEQ ID NO: 1351 - DNA, 309 bp, Homo sapien
ccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttgg

SEQ ID NO: 1352 - DNA, 268 bp, Homo sapien
ccacttcatctgtgtgggaacgtggtcaggccgggtgctggtgtttgacatcccagcaaagggtcccaacattgtactgagcgaggagctggctgggcaccagatgccaatcacagacattgccaccgagcctgcccagggacaggattgtgtggctgacatggtgacggcagatgactcaggcttgctgtgtgtctggcggtcagggccagaattcacattattgacccgcattccaggatttggagttccgtgcccctctgtgcag

SEQ ID NO: 1353 - DNA, 620 bp, Homo sapien
  misc_feature (1)...(620): n = A,T,C or G
cctgagtaattattccatcatagacaaacttgtgaatatagtggatgaccttgtggagtgcgtgaaagaaaactcatctaaggatctaaaaaaatcattcaagagcccagagcccaggctctttactcctgaagaattctttagaatttttaatagatccattgatgccttcaaggactttgtagtggcatctgaaactagtgattgtgtggtttcttcaacattaagtcctgagaaagattccagagtcagtgtcacaaaaccatttatgttaccccctgttgcagccagctcccttaggaatgacagcagtagcagtaataggaaggccaaaaatctccctggagactccagcctacactgggcagccatggcattgccagcattgttttctcttataattggctttgcttttggagccttatactggaagaagagacagccaagtcttacaagggcagttgaaaatatacaaattaatgaagaggataatgagataagtatgttgcaagagaaagagagagagtttcaagaagtgtaattgnggcttgtatcaacactgttactttcgtacattggctgggaacagtcatgtttgctttcataaatgaagcagcttt

SEQ ID NO: 1354 - DNA, 398 bp, Homo sapien
aaaggattatttttatgcaaagtattctgtttcagcaagtgcaaattttattctaagtttcagagctctatatttaatttaggtcaaatgctttccaaaaagtaatctaataaatccattctagaaaaatatatctaaagtattgctttagaatagttgttccactttctgctgcagtattgctttgccatcttctgctctcagcaaagctgatagtctatgtcaattaaataccctatgttatgtaaatagttattttatcctgtggtgcatgtttgggcaaatatatatatagcctgataaacaacttctattaaatcaaatatgtaccacagtgtatgtgtcttttgcaagcttccaacagggatgtatcctgtatcattcattaaacatagttt

SEQ ID NO: 1355 - DNA, 371 bp, Homo sapien
ctggytcctcagtgggaactgagtcattacctgctaaagggtagaagaggagagagagaggccagagcctggggatggggcagaaggtgcagcaggaaggaaggttagagtgagaaaaatttccaaataaggggtgatgtgtgagtgctcagagggtgactgaggacatctccagcatttccattgaggagggaggaaggaggggcccttgggttctggggcagatgccggcagggtctggatgagatgcccccaacctcaaccctggtcctctgaaaacacttcacccagtcacactgaggagcccctccaggcccaggggcccctccaggtaggcgtatctcagctcctctctggaaggacccccacag

SEQ ID NO: 1356 - DNA, 338 bp, Homo sapien
gcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcag

SEQ ID NO: 1357 - DNA, 159 bp, Homo sapien
ctgggctgctgcctctggagtacttccccgcagctcctcattgctcacatagtaggcaatggcgttgctctcaaacacacagaatccatcatcaccctcaaatgctgggaccttgccggcaggaaatttgcggagaaattcaggggtgcggttggtttg

SEQ ID NO: 1358 - DNA, 306 bp, Homo sapien
cctgtcagagtggcactggtagaagttccaggaaccctgaactgtaagggttcttcatcagtgccaacaggatgacatgaaatgatgtactcagaagtgtcctggaatggggcccatgagatggttgtctgagagagagcttcttgtcctgtctttttccttccaatcaggggctcgctcttctgattattcttcagggcaatgacataaattgtatattcggttcccggttccaggccagtaatagtagcctctgtgacaccagggcggggccgagggaccacttctctgggaggagacccaggc

SEQ ID NO: 1359 - DNA, 382 bp, Homo sapien
agagggagtccagcccccaagccttgtgaggcactgttargcagatagggaaaagaggggtccttagatcactggttcaaggagggatctggtaggggcagcatttcttctgggctggaaacagaatgggggtttcaagatggcagaaccattccattattggagctataagcccctagaattgctccatggcctatctcggtttcccttggatctcatctgctcctgaactgcacctgtcatggcaagtccatctccggcccccatctcccctgagccaatgtgagtcaggtgaacaaaattcattggttccccaatcatggtccggtcaatccgtcttctcttcttctttcttctccaccatccagacgttcagctacag

SEQ ID NO: 1360 - DNA, 365 bp, Homo sapien
aaaaaacctttcaaaataaaacttagtaaaatctagaactgkttcttggcctacttgagaggaacttccatattttcacagccatctccgaaagcagcagttgctgtaaattaactgagacttggaaatggtgcagactgtcttggtagagctgttcttatagcacaattttatctggaaaataaacttgtaaatgcgtgctgtatattaatacatgtgtgcccatatttatttttattatctcctgccagtctttgctcaatgggagatgacagaccaacttctcaacgtgatttccccatttcattgaatgacatttatatgccacttatgaaaaaaatactgctgtgaaagaaatgtacttt

SEQ ID NO: 1361 - DNA, 502 bp, Homo sapien
gaggtatggaaaaatatcaacaaggaaatattagatttgaactgctgcttcgttagcacacagcacattctccaggatataccatatgttaggacacaaaacgggtctcaataaatttttaaaagtcaaaatcttatcaagtatcttctcagaccacaatggaataaaactggaaatcaataacaagaggaacttctgaaattgaacagatacacggaaatcaaactacatgttcctgaatgaccactgtgtctatgaagaaattgattttaaaaatttaaaaattctttgaaacaaatgaaaatagaaacacagcatacaaaaatgtatagggtacaacaaaagaagtgctatgagggacatttatttcaataaacacccacatcaataaggtagaaagtttttaaacaaataacctaataaacgcatctcaaggaactagaaaagcaagaacaaatcaaacctaaaattagaaggaaataaatagtaaagatcagagcag

SEQ ID NO: 1362 - DNA, 545 bp, Homo sapien
ctgattggatgtctaggaatgactgaaagaaaccaaaacagcctgtccactgctgctgtgggatggaggaggcgtaagcagaaacactaacagtatactgacctcttagcagaaccgcttccattctggagatcacggctgctaaatccagcatccccacttcattttacccccagcatattgttctgtagtcttttcttgaaacatcttgattgcttttcctcggcagctttcaaaaaaccaaataataatagttatccgtcttctacttcatggaagattgttttggtgccctgaccctctgaagtgcccagttcctgccatctgaaacctcggcctgatctgatctcatgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatgaggcccgctgacctctgcgggacttt

SEQ ID NO: 1363 - DNA, 286 bp, Homo sapien
gggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctgg

SEQ ID NO: 1364 - DNA, 503 bp, Homo sapien
ccatcaggatcatgaaaacaaactttggtgaatgtgagcaactgcgccagacaggacacaggttacagggcctgacgtcactaacggtaactgacaatcttggaatggaccctactgctgatgtttcaaaaggacacagaggtgaactggtcacttctaattaagaagagccagtggggtgggggaagctgaaaaccaaaaatccacgtagacatacgtggcagtgtgaacgtctgtcctccccttccttctcctcacttcctctcctcctcctcactcaggctggtattctcctggtgtgcggatgtcagcttgccctgcagaagggctgccagttttttagatgtctttttgagaaacgagctgcccggatgggcactgttcacgtgcaggtacaggtcctcctgggtggggcccgtgtagccgcaatcctcgcagacgtagagcttgtcccgccgctgcttataggcatactgctgctgcaccccatggattttcttcag

SEQ ID NO: 1365 - DNA, 245 bp, Homo sapien
ctgggcggctccacgctcatccagtgggcctaggttctgactgaccagcgaacaaaaactgtgacagagatctaggatttcattcaggcagtgaaacacctacccgggaaacagagttggcattaggaaaggaaggaaggtacatccatgaagttaaagtgttaggagaacagtctgattaatagctgatctaattaatagctgacctcccaaatctgacaggatagacactgccacgtgcaagg

SEQ ID NO: 1366 - DNA, 131 bp, Homo sapien
aaaatccccataaatcttttctgtcctgaggtagttgcaaaataaatcataacttggatatcaactagagctgaggctttgactttttactcattaaaactagttgttacaggaactacctttagatattt

SEQ ID NO: 1367 - DNA, 430 bp, Homo sapien
ctgtgcagttatatgaccataaaggaaatgaaccattaaaaatggatctacagccatatattctgccgttactcagaggcttaatgatttattttccccctccagccctgcctttaccaggttaaatgacagaagaccttctattgtacctattgttcaaaaaatattactgttctgtggaacctgggagagtccaattgataagagaaactgaatcatactgatgaggtgaaggataggtctgccggtgtggggcagggcactctttctcagcagccaagataacttatcacacacgaagcagagagaatgcacccgatgaaaatctctctgaactgtgttccttgaaggatctcttaaaaaaaaaaaatctgaaacatcatccattgaacaaatgaaaggcttatacctttaccatgaagaaacattt

SEQ ID NO: 1368 - DNA, 294 bp, Homo sapien
ctgggcggatagcaccgggcatattttggaatggatgaggtctggcaccctgagcagtccagcgaggacttggtcttagttgagcaatttggctaggaggatagtatgcagcacggttctgagtctgtgggatagctgccatgaagtaacctgaaggaggtgctggctggtaggggttgattacagggttgggaacagctcgtacacttgccattctctgcatatactggttagtgaggtgagcctggcgctcttctttgcgctgagctaaagctacatacaatggctttgtgg

SEQ ID NO: 1369 - DNA, 429 bp, Homo sapien
ctgaaggcaatgggggactgaggaaggaggcagcagaagtaggagaggagcaagaatccagaagggaaatgagaacgacaaaactgaagtgcacttcaacatcctgcagccaaaggggtaaaaaggagaaagaagtgcagaccagtcacataaatgccacagtgacatgcacaaaaacgtgaggggcacactccagggacagagtctgacaacatgacaagctacatggcatcaaactctttcatgtgacaggcagcttttcacatgtgcatcttaagactggaacttgctatagataaaccttaagtagttaataaaagcaaaagtcatcctctattcactgtttgctgccatgttccaggcatagtacttggcactttttattttatttcacttgatcagctcagaaagtcctccaaatgagtattt

SEQ ID NO: 1370 - DNA, 540 bp, Homo sapien
ccactcccaggatgctgggtctcgcttgctggctgggaccccggagccgtcagtccacgcactcccggatgcactcaacaacctaaggacgcaggagggttccggggatggtccgagctcgtccgtagattggaatcgccctgaagatgtagaccctcaagggatttatgtcatatctgctccttccatctacgctcgggaggtagcgacgccccttttccccccgctacacactgggcgcgctgggcagaggcagcacctgctttttccctacccttcctcgattctgtccgtgaaatgaattgggtagagtctctggaaggttttaagcccattttcagttctaacttactttcatcctattttgcatccctcttatcgttttgagctacctgccatcttctctttgaaaaacctatgggcttgaggaggtcacgatgccgactccgccagagcttttccactgattgtactcagcggggaggcaggggaggcagaggggcagcctctctaatgcttcctactcattttgtttctagg

SEQ ID NO: 1371 - DNA, 142 bp, Homo sapien
ttaaaatggtagcacaagagtctggcaagttggtactgcagagaaaaggggttaattgaggcttgtttggagtcgggattcccctttcccaaacatgcgtctcgccacttggacagcagccatttgtactcgtatacttttt

SEQ ID NO: 1372 - DNA, 377 bp, Homo sapien
ccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcag

SEQ ID NO: 1373 - DNA, 504 bp, Homo sapien
ccatgctaagtttgggaaccgctggtgatgggacatggatgcttgcaaccgaccgtgggcggatgtggttgaccagatggcagaggacgacaccatccatgagggctgcccccaggtcttcgtgcagactgaccttcaatctcatctcaatgctctcacgaagttgttccaccagctctttctcttctctcatctgctccattttcctccggattgtaaactgcgggtctatagattccaaatttctctgaggtcttagaaacacagactcagaaatcaaatgaggatgtctcagaaaggagtcacttttccagaggcaggctgccccttaactcagccgagcagcaggaaccactggggccaaagctattttatcttccttaggtaaaaaaaaatcaatagaatatttcttccccgcttacatgctcccaccactgatgaacgcgatcttcagcaagaagaactttgagtccctctccgaagccttcagcgtggcctctgcag

SEQ ID NO: 1374 - DNA, 201 bp, Homo sapien
cctccgtaagatgcttgacaattttgactgttttggagacaaactgtcagatgagtccatcttcagtgcttttttgtcagttgtgggcaagctgcgacgtggggccaagcctgagggcaaggctataatagatgaatttgagcagaagcttcgggcctgtcataccagaggtttggatggaatcaaggagcttgagattgg

SEQ ID NO: 1375 - DNA, 295 bp, Homo sapien
  misc_feature (1)...(295): n = A,T,C or G
ctgtgaggctgnttccaaggaggaaaacaaggaaaaaaatcgatatgtaaacatcttgccttatgaccactctagagtccacctgacaccggttgaaggggttccagattctgattacatcaatgcttcattcatcaacggctaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactgg

SEQ ID NO: 1376 - DNA, 318 bp, Homo sapien
ccagcgctactgtactggcccagggcagagttcatgtatctcgtcttgaccacgtctacaggggaggcgatgacagtggtgcagaagcctgccccaaaggcagaagtgaagtggcaagggaggtcatctgtcatgaggttggctttcaggagggcatccttgatgaggtcataggtcaccagctcagcacagttgacaatggcattacgagcaacattgggggaggtccctttccagaggccccggaacccttcctctcgggcaatggtcttgtaggcattgacggtgctttggtatctccgaccacctccagcccgg

SEQ ID NO: 1377 - DNA, 143 bp, Homo sapien
gtggattccgytccgggcaccgatctcgccaagatcctgagtgacatgcgaagccaatatgaggtcatggccgagcagaaccggaaggatgctgaagcctggttcaccagccggactgaagaattgaaccgggaggtcgctgg

SEQ ID NO: 1378 - DNA, 98 bp, Homo sapien
aaatattggtaataggtcggcaacagcaactatagaagtacaactcaatagatggcattaaaacatattgtagtgtggatatatattttttctttttt

SEQ ID NO: 1379 - DNA, 330 bp, Homo sapien
aaagatgttcacgttacgctggaccaaattaagacggctttctccctcttgctgacgtgccccagccgtgataatgaccagcttggagtttgcagttacattatagtctttgccagagacaatctttggtgttctaaggaaaaggctgccatgttggagatccatcatctctcccttcaatttgtcttcgacgacatcaacaagagcaagttcatctgccaagtccttcattaagatactgatggcacaggccatgccaacagcaccaaccccaacaactgtaatcttattctggggggtctgttcttcctttagaagattataaatcag

SEQ ID NO: 1380 - DNA, 269 bp, Homo sapien
ccactcctggaaacccactgatagatgagtttcccccattcttctggcctccgccacatgatcaggaagctggacttgctcttatccaaccactcgaggttccctttcttcctcagttcctctaatacaatctggatcgactccacaggaagctttcgctgtagcttgacgttgttgaagagcgggctctcctgagcttccatcaccgtcatgctggactgtttgtgcaggcggcagaaggacaggaccagcgagcaccaggcggccag

SEQ ID NO: 1381 - DNA, 232 bp, Homo sapien
aaaagagaggaaaggcagtgcagggctggaggtcctggagggtggcggcgggtcgtcctaactagcaggctgaaaggtgctggaggggatgccttcactcagaggaagttcacagccacctgccttggaacatgtacctgttcatcttttcgtaatgttagtattcattttgctatcttcctgttgccatttccaaacagtgtcagtatgtttttgttaaatacgaacattt

SEQ ID NO: 1382 - DNA, 348 bp, Homo sapien
aaacgtgctaaagggaaaggaatctgacattctgggtaaatcttactcaatctaaatcaaagcttggttttcaggaggaggaaggtgcgagcgcaggcagaggtgctgaatactcctcttctgattcacttccatcatcctctttctcttggtcactgccctcagtgctaagccggtcaaacccttttcgactgtagcccttacggcttgcaaagaaattaccaaggtttaagcctccacttccctttcctctaaatcttcccagtactcttcctgaactcgtctcgagtttgtgttcagaatctccaaaggcccttgattttttccaccgaataaatatggcaatgg

SEQ ID NO: 1383 - DNA, 293 bp, Homo sapien
  misc_feature (1)...(293): n = A,T,C or G
ctgcttcaanacctcagcttcatgggacttgcgtctttcttctgcagcttctaatttcttctgaatttcctccagggaaagatccttcttctttggaggggaaagggggaattctggaacagattcttttgaccgagggctgagaatcagctcaaaagcctggcccgaggcacgcttctccagttctttcacctggatatcagaagaagccatggtgaatagaagacaagcgacaggcagtgtattctgcacaatcaactgggataaggaaagtcctgctcagtccgagccgc

SEQ ID NO: 1384 - DNA, 573 bp, Homo sapien
ctgaagcaacttgggattaattgcttgattagcttcacgaagcacagagataaggtcgctcacttgctttatgttattaggtgtaaagaaagtgtatgctgtgcctgttttggtactgcgagcagttcttccaattcgatgaatataatcctctgaggagttagggtagtcataattgatgacaaatttcacatcttccacatctagccctctggaggccacatctgtagcaatcagaataggagcttttccatgtttgaattcatttagaacccagtcacgctcttgttgactcttgtcaccatggatacccatggcaggccacccatctctcctcatttttctggtaagctcatcacatcttcttttggtttccacaaaaacaatggttttattctccttctcactcatgatctcttccattagacgaataagtttttcatccttttctacgtcatgacacacatccacaatctgaagaatgttgtggtttgcactcagttcaagtgcaccaatgtttatatgaatatagtctttcaggaaatcttcagcaagctgtcttacttcttttgg

SEQ ID NO: 1385 - DNA, 150 bp, Homo sapien
ccaaggccgctagggtccttacccctcaggatcactccccagccctttcctcaggaggtaccgctctccaaggtgtgctagcagtgggccctgcccaacttcaggcagaacagggaggcccagagattacagatcccctcctgtaagtgg

SEQ ID NO: 1386 - DNA, 159 bp, Homo sapien
  misc_feature (1)...(159): n = A,T,C or G
aaatgatgttttggttaagagtggaccatgagaattagctgacagcatcccctttctctctccctgccttggtgggaccctccctgtgtgaccttggtcaagtcctcgaacttttgtcccgtatttaagatggagctgntttacctacttcataagaca

SEQ ID NO: 1387 - DNA, 735 bp, Homo sapien
  misc_feature (1)...(735): n = A,T,C or G
ggtgnaattcgcctttgaanggccgccgggcaggtcctttntgtstgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgccctttctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcaga

SEQ ID NO: 1388 - DNA, 369 bp, Homo sapien
ctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacag

SEQ ID NO: 1389 - DNA, 322 bp, Homo sapien
aaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgccgccatcttagctgtggacaaaggggggtcag

SEQ ID NO: 1390 - DNA, 450 bp, Homo sapien
aaatattagwtgagactttacaggcacataactgttcagatagaaacaaacataacagactaaaatactttcaaaattaaagccatctagaaaatggaagtaactgaaactgtagccattacaattctttttctggttttgagcaaaaattttatctctctggcaaaacacctttgtctgatcatttgagagacagggttcttgtatactgtttcttcaacgtaaacctcatttacaaaaatagtgacatagcattatgaataaactatgaattggggaccatggaaatgcactagaacaaattttgtaaaaatatggcagatatggaagttaaaaatagaatggatgcaaggactgtactaaaggtgtttggtgtagttacaatgttcactttgcacaactatccctatagtctaggtagccattgggtttctcctcagcagtgtcaga

SEQ ID NO: 1391 - DNA, 304 bp, Homo sapien
aaaaaatcataaatggggtttcataatccaaagttgaaacatttattcttcatagcttcagaatttaacaaccaattgtagaccatgctttccaaatccagtcttctttgctatttttcaaaacttctgagatctagtattaaactgctccattctaaatgtatagttttagataagtattgtacacttgttgataagggttttctgaaagcagtctatcaaatataaagaatggtttctatctaagaatcagcagtgagggaagaaatattaaacacctatcaagaaatcaattattcatttt

SEQ ID NO: 1392 - DNA, 140 bp, Homo sapien
ctggaagaagaactgagacagcagaaagaagcagcttgtttcaaggctcgtccaaacaccgtcatctctcaggagccctttgttcccaagaaagagaagaaatcagttgctgagggcctttctggttctctagttcagga

SEQ ID NO: 1393 - DNA, 166 bp, Homo sapien
aaaactttgtttttcttaaaagcttacagtgtttggctaattctcctcccctttttacaagacgggggccggagggtggacactggtggcaggttaagggatactgtcactttaagaagcctgcagattgaagtgtaaacatggagaaattaggggctgatttttt

SEQ ID NO: 1394 - DNA, 543 bp, Homo sapien
gcagaggctgtggtacaacatggtccttggtgaagacctgcacccctggaacctcccaccatcatcacaactgtagtctcatttgcagtggagaaaagaacccgacgtcccacagccagatatacacccagctccatgccagcccttcatgtttaccttttgctttgttaattacatgtcagactcctagagggcctccagactaataggaagcatttctgtaaccaacctgccacccactgattcagaaatggaaatcacattccacaatctatggcttctaccagctagcccaggaaatacttgaaatcagcattccaattagtgttgagtctcttgattgtgtcatttaccaattaaataactgagacctaagtctgggaacagagccacgaatctgcctttgagatgctggcagatctcaaggccatcaattattgggggagggagggacaaacactcccaatcatccaccagtcagactgaatgtgtagctggcgaggaattacttccacttctggcccagcacaagccctgctttgg

SEQ ID NO: 1395 - DNA, 364 bp, Homo sapien
cctatcatcagtggggttgtattcaccatcatccagggtaccatcttcatacaaggtactagctatgaccaaccgaaacttgtcacccaagtctacagggtaaatttgaatgtttacatctaagattagatccatcttgaaagattcactctcacaatgcagtcgagacactcggtcaaacttcttgccctccgggtcaatatccttcacatcgaaaatatcctcaaacaggatgcccgccatcgcgagggggccacgagagcagcagaaggggtgagagcgcgaccacagttgggagtacgtgcaccccctagcgtggacaagaccggagagaaccaaaagcacctcctgaaagcgcggcggc

SEQ ID NO: 1396 - DNA, 422 bp, Homo sapien
gctgctgctgctattgtgtggatgccgcgcgtgtcttctcttctttccagagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcag

SEQ ID NO: 1397 - DNA, 653 bp, Homo sapien
ctgacctgctatcccaccccaaatttcagcctgaggtatatttcagtgaaggcaggtagctgtgcttctcagagcagagaagcagttttaagagcaaaaaggtagaggaaatctagaaaagaaccgtcttgatacagatttatcccatggtgtgaagggagggcaaagaacccagtggcacttcgcttatccagcaatttctgtcactgtggtgaccaacttctgcccgttccatagggtcttgaactgctcaggaactgggaattcattaaagtcaccgccttctgtaggaatgaggacattcatctcggaagatttggcactgactatttcacaatccagggaattcttgctcaggtaagcatggcagccatctgttttgttgatggatatggttggcactttacccattacctgaactttgacatccttactgttgattatctccacaatgcccaccacgtcatcgaataccaggccaagtttcttacagttatctactgtaatggagttaattttgcccttgatttgcaatgtcgtgttgacacacttgtatatgtaagccacctgtttcagctctgtgtcctcaatcaccagggtggaaacattttcctgattttccctctcccttcttgccttcagttcaagtacag

SEQ ID NO: 1398 - DNA, 261 bp, Homo sapien
aaaattataactactcattctttctttagccttagataatttgagcagaagccacaacaagcaaaccacaataaatttagaattggcagaaatccacattaactcctcttcccaagtttccacactactaccatttacagttgtaggtttgtaatgtataattatgtaatgcasaaactagctttgacttgtgtracgatgcactgtcaaaggaagcaaagtaagaattgaaattccacattcccagaatttaacactcag

SEQ ID NO: 1399 - DNA, 195 bp, Homo sapien
ctgattttatttccttctcaaaaaaagttatttacagaaggtatatatcaacaatctgacaggcagtgaacttgacatgattagctggcatgattttttcttttttttcccccaaacattgtttttgtggccttgaattttaagacaaatattctacacggcatattgcacaggatggatggcaaaaaaaagttt

SEQ ID NO: 1400 - DNA, 120 bp, Homo sapien
ctgcctccaaccctttgggtctccaccacccaagtttcctgtagggtccgccgggtccaggatcacaggcctgggtttcgtgagctgccttctcaggtacttttcaataatggggttttt

SEQ ID NO: 1401 - DNA, 284 bp, Homo sapien
ctgtagccaaaaagatgctggggcagattgtggacaagtagaagcacctccttcccctctgcgacattgaacggcgtggattcaatagtgagcttggcagtggtgggcgggttccagaaggttagaagtgaggctgtgagcaggagcctctgccaggggacatgcaatctgcagggaggggctgaggggggtcccatggtctctgctgtcttctctgtccacctctttgtagaggagcttgagctccaggaatgctctggtcagggctgctgtgactgttggcc

SEQ ID NO: 1402 - DNA, 198 bp, Homo sapien
ccaggtttctgctggtaccaggctaagtagctggtgctggcgggaacactgtgactggccctgcaggagagggtggctctttcccccggagacagagacagcgtgtctggagactgtgtcacttcaagctctgcgatgccatctgggagccagagtagcaggaggaagagaagctgcgctggggtttccatggttccc

SEQ ID NO: 1403 - DNA, 441 bp, Homo sapien
aaactcaaaattgacaaattaactagcttgctttttgtcatttggaagactaccattattcaaatttattatgtaatacactcatccagataatgaaacatctgcgaaaaaaagtgtgggaatcacctcatctgtgcataaaatggctattatacatgaatgcagacgtttgaagttagaaaggaatataactcaaatagcaaaaggtcctaattacagagtttacaaataagcagttttattttcaaaagtacatagtaagtccagactgggctattgccaaagaactaatctttagtctacttcaacatgttacatggtattcctgactctacagactatcagcatctgtggaggttagctcctaaaggtcccaaagaacaggaaacatgcaggaataaaggactcctcatgaagagcaggtgggagcgagtgggcagg

SEQ ID NO: 1404 - DNA, 243 bp, Homo sapien
tgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatgg

SEQ ID NO: 1405 - DNA, 168 bp, Homo sapien
aaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgttt

SEQ ID NO: 1406 - DNA, 486 bp, Homo sapien
ctggacatacagaaattgttgaatttttgttgcaacttggagtgccagtgaatgataaagacgatgcaggttggtctcctcttcatattgcggcttctgctggccgggatgagattgtaaaagcccttctgggaaaaggtgctcaagtgaatgctgtcaatcaaaatggctgtactcccttacattatgcagcttcgaaaaacaggcatgagatcgctgtcatgttactggaaggcggggctaatccagatgctaaggaccattatgaggctacagcaatgcaccgggcagcagccaagggtaacttgaagatgattcatatccttctgtactacaaagcatccacaaacatccaagacactgagggtaacactcctctacacttagcctgtgatgaggagagagtggaagaagcaaaactgctggtgtcccaaggagcaagtatttacattgagaataaagaagaaaagacacccctgcaagtgg

SEQ ID NO: 1407 - DNA, 560 bp, Homo sapien
aaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggagttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatattt

SEQ ID NO: 1408 - DNA, 360 bp, Homo sapien
ctgcctagttgtagttgacagacaactttataagctctagtcaaccctattgactaagcttctgaaccactagcatagttctagggtcaggcggatgcctactgtgggcaggaaagtgatgcatgcatgtgtgggagcagtgtcttaatgtctgaaatagtagccatgagctacatgtggctatggagcacttgaaatgtgggagtccaaattatcatgtgctgtgagtgtaaaataatatgtttctaagaccgtgtgtgaaagaatataaaatatctcattaaaaaatgtttatattgagtacatgttgaaataattttatatttgtgacacattgtgttaaataaaatattaaaattt

SEQ ID NO: 1409 - DNA, 208 bp, Homo sapien
ccagtccaacctgctcctcattattgtataaatgagcagaatcaatatggcggaagccagcttcaattgccaatttggtggcctctaaagctttacttttaggaacctctgcaggcgcataggtgccaaatcccaggacaggcatgaagtgaccatcattcagcttcacacactgatatttcgaatccatttctgtcactagcctggc

SEQ ID NO: 1410 - DNA, 404 bp, Homo sapien
aaaaaaaggaaaaagttttattacgaaactagtttgtataaaacagggttatacatatttttgtaagtttgtaataaaacagtaagaaaaaaaaggcagtaatagaaatctccaaaaggcaacctatcaaaaccaactggctgccactttgagtttggacagtagctgcataaactttgttcttcttgarcagtatttaataacatcattaatacattaacaacatttctataaagtaagacacattggtgctgaagtacaactggtggcctcttgatctcacctatgaggagagttctttacamawccacatagggaaaattgcagttgtaaggtgarctacacatctaaaatatgcagaggtaatagcattacatgttaaagtatcaagatatacacatttt

SEQ ID NO: 1411 - DNA, 623 bp, Homo sapien
  misc_feature (1)...(623): n = A,T,C or G
ccacttgttgagatatggggagcctacactccggagggstgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgnatgggctggtggctgccatgcagccccgaatgctggttacngtttgatgaggagctgcggccattgccagtgtctgtccgtgtgggccaggcagtggatgtggtgggccaggctggcaagcccgaaaactatcacagggttccagacgcatacaaccccagtgttggtgggcccacggggaacgggcagaattgg

SEQ ID NO: 1412 - DNA, 171 bp, Homo sapien
gcggcgctgggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccag

SEQ ID NO: 1413 - DNA, 189 bp, Homo sapien
aaaagtcataagggttttattttgtatcatcaaaatattctataaggtcccaaatactctttttcaacccatgaacagtaagaatttgtgaattctgataatgaaaaaagttttcctccaggtatgtttgtttcacattcagtcctaaagccttgagctatgtgtacttccctcacacaggaacaccag

SEQ ID NO: 1414 - DNA, 564 bp, Homo sapien
  misc_feature (1)...(564): n = A,T,C or G
cctccccagcgcccaaaggtctattacaagtacctatagacttttcacatataagttctagtgggtacaagctttttttttttttttttttttttttttttctattgggkatttcattcattttggggggggaacaaattctacaaactgctttaatattgkcctttttttctaatattcacattaactttttatgtaaaacataccaatgcttttaataaagcttacataggaataaactattatagacctgcatagatataagtacccatgtattaatctacattaaaataatggattttattctgcgaaractccaagttgctcctgggkgctaagkgaagcacttagggaaatgtgttcagtctttgaggtcataggaacattarattatatcaaaggaaacctggagccatcagctaagtggcccttctgtcctgtagatacataaaaactaatgggctccgctatgcggctcactttctgctattagatactatgaggcactaanaaaaaactactgcctgcatcatatctttcttcggtttgagataaagagaatgg

SEQ ID NO: 1415 - DNA, 231 bp, Homo sapien
ctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccatttttttttgtcttt

SEQ ID NO: 1416 - DNA, 540 bp, Homo sapien
cttgatttaggatctgtggtgcagggcaatgtttcaaagtttagtcacagcttaaaaacattcagtgtgactttaatattataaaatgatttcccatgccataattyttctgtctattaaatgggacaagtgtaaagcatgcaaaagttagagatctgttatataacatttgttttgtgatttgaactcctaggaaaaatatgatttcataaatgtaaaatgcacagaaatgcatgcaatacttataagacttaaaaattgtgtttacagatggtttatttgtgcatatttttactactgcttttcctaaatgcatactgtatataattctgtgtatttgataaatatttcttcctacattatatttttagaatatttcagaaatatacatttatgtctttatattgtaataaatatgtacatatctaggtatatgctttctctctgctgtgaaattatttttagaattataaattcacatgtcttgtcagatttcatctgtataccttcaaattctctgaaagtaaaaataaaagtttt

SEQ ID NO: 1417 - DNA, 350 bp, Homo sapien
  misc_feature (1)...(350): n = A,T,C or G
ttnatcatctaactgtgggatctatttcatttctggaaataacacaacttagttctagggctttcatgcacatgaaatataaaacagcttagttgttctgaaaacatgacaatggttaattttattcaagtcccaacactgagttcagagcacttctccataggccccattaatctctccaggtttctgggagtatcattaaatccctcggcatccttaagaagcaggtgcttagcaaacatccagtttccaaatgagagtcagaggggcttgatcctgaaagtgtagtattttcctgccttgtcctactggtatagcttcttggacctaaaatctctctcctgctgagg

SEQ ID NO: 1418 - DNA, 425 bp, Homo sapien
tgctaggcagccttattttcataacccawttagggaaaggaaatttaggattttcaaggctacattaatttttcctccatcaaatcttgatttgttcttgataaaaatgagttcttttggggaaattctttctttagacaccaacttggtttttctcatcttccacagaataattgaacccctgacctctagatgttcaaaattccgcttcaagcctctgtcagataaaattcaacagcagcgattactagacattgccaagaaggaaaatgtcaaaattagtgatgagggaatagcttatcttgttaaagtgtcagaaggagacttaagaaaagccattacatttcttcaaagcgctactcgattaacaggtggaaaggagatcacagagaaagtgattacagacattgccggggtaataccag

SEQ ID NO: 1419 - DNA, 390 bp, Homo sapien
aaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggctttt

SEQ ID NO: 1420 - DNA, 480 bp, Homo sapien
  misc_feature (1)...(480): n = A,T,C or G
ttgctgaacaatgacatcgttttctccaggggttgaaatccatgtccatggctgacaacccaacaaggctgggacccaaattcgtacagagatgaggcagagtggagagaaacaactctggctgagccagagtctccagccactacttcttattcctgggctttagctcttcggctgcattacgcaggaaaatgtaattttttttctggggattataaaattcatgtccctttgaccagtcgtagctggaagcgtatgcaaatatgtttccattgygattgaaacagcaagctgasatgggctgayctaactgttccgaagnttttagttttgktctggcatctttgycccagaagctgaatctaccatcagatcccacagttgcaagggtgccatgaacaggatggaacgccgattccatttacccgcataaatgycctgaggagctgaagtgttggttccattagatcgatgacattt

SEQ ID NO: 1421 - DNA, 453 bp, Homo sapien
aaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagcttt

SEQ ID NO: 1422 - DNA, 542 bp, Homo sapien
  misc_feature (1)...(542): n = A,T,C or G
tttncttgaccactatacggcacaacctaggggstgtawaaaacctascrcaatgcagaagggtgaagcttcatgacaattggtctcggcaataatttgggggatgtaacatcaacgaatcagacaacaaaagcaagggaatacacatggnactaaatcagtgtgnggaaaaatatcccaaacaggcaaagcacaacatggamtagatatatgcacattnatggaccctgnaggcakkactcacaaacatactacctgggaagcamctggacctttaagggatgaggtagattcaacaaacagggcancgtatmttccactgggatagcattccagccttaaaaataangaaatcttgaaaagnactacaataaggacaaatctcgaacacattctgttaagtaaaacaagacaagccaaaaagggaaaactgtataattacacctatgtaaaatatttagtcaaactcaaagaaaccaagtgttgtagtctcagcagggcaccaagatgnaaacagtctctcatagnctgagatangcatc

SEQ ID NO: 1423 - DNA, 252 bp, Homo sapien
ttaatgccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcag

SEQ ID NO: 1424 - DNA, 273 bp, Homo sapien
tttccactctgcacattgtagagggaacactctgtaggcccatgggtcccttactagagaggttgagtgaatttgccttcagttaacatgggaccttctgtttagcttcctcttgcttcccaaagattttaagcattttgtaaatgtataaactcacctctggtaacagtggcccagacgctgctttgtgctaaaagcatgggaaatgtaaaggcagtctttctctgggaaatggatgctattctattctgctgcccctacctgttcctgagg

SEQ ID NO: 1425 - DNA, 618 bp, Homo sapien
aaaaaccttgtatagcaaaataacttaaaaccctttgtgatatcatcttaccagtttatttggtaaaaacaaacagttatttggtatttgtcagaattcttcagtgcctgctattacagctattttccaattactaatttgattatactcactcaaggcagtgcaagatcttgaagtactttttagcagttaagtaatattgaattgtattgaatagtttacatagtttattctagtctttgaaaattactgaacatggacaatgtgcatgtcattgacatctgccttagaacttctgggacaatcctgattcgagagattctatcccattatttacatataccaaaaatactttgttaatttaatgtgttggcttcccaactcctgaacacgacacaattttattattagattttgtatggtgattttaggctatgaaaacatgatcattatatgtatatagatacatttttatttgttacaaatgtttgagcagctcactagcccacccctcctctattttgggtaagagaatttactaccttttttaactatgtagttgagagcaacatgtattttgttatttttagaatggtcagtatattgctataaaatttt

SEQ ID NO: 1426 - DNA, 565 bp, Homo sapien
gtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaag

SEQ ID NO: 1427 - DNA, 144 bp, Homo sapien
ccactagttatttttatgtaatcaattacggggtcattagttcatatcccatatatggagttccgcgttacataacttacggtaaatggccgccaccgcggtggagctccagcttttgttccctttagtgagggttaattgcgc

SEQ ID NO: 1428 - DNA, 214 bp, Homo sapien
ccactagttattattatgtaatcaattacggggtcattagttcatagcccatatatggagttccgcgttacataacttacggtaaatggcccgcctggctgaccgcccaacgacccccgcccattgacgtcaataatgacgtatgttcccatagtaacgccgccaccgcggtggagctccagcttttgttccctttagtgagggttaattgcgc

SEQ ID NO: 1429 - DNA, 253 bp, Homo sapien
  misc_feature (1)...(253): n = A,T,C or G
ccactagtccantttngtggaattctgaagccttaattgcttatatccatgtttctagtgaaatgagagggtataacaaaaaagagaacaggaggaaagcttcgctgtgcctgaggaaataatctagtcaaggcagcaagtctggatagtgctatagagatgagatacctgagcagttccagaggaagaggtggagatcagaggccagttttcagtgaacactgtaaagaaaagccagatgatgtgtcctgga

SEQ ID NO: 1430 - DNA, 232 bp, Homo sapien
aaattttactagtgttacttaatgtatattctaaaaagagaatgcagtaactaatgccctaaatgtttgatctctgtttgtcattactttttcaaaattatttttttctgtaaagtataatatataaaacttcttgcttaaattgaatttctatattagtggttaattgcagtttattaaagggatcattatcagtaatttcatagcaactgttctagtgttttgtgttttt

SEQ ID NO: 1431 - DNA, 734 bp, Homo sapien
cattatacaacactatattgccaggtcaaagagggcagggacgtaaatgtacactaaaatgcmaatgtatcccaaagagataaaacaaattccatttacagcatgaaggtttacaaatgtacacctgtacaaccaaggaaagcatcactactaaattagcaaggcttttataataaacattgaaasaagatttcctttcaaagtgtaaacttacatctattactacacacacaatgcatatatttatagaaagcaaaaagagctatctgaatatgtaatcatgcttaaatgctgagctatcaaattcacttttcagtggccccttttcatctctatctggttcctactttctgcctctatgaaaaagcaaaataaagctcaacacttcctcaacatgtctgtaattctataagcaaaacaaaatacaaatttccactctttctcattgcaaaccaaactgaaaagttaataagtgacttaacttttcatttagtgcacttaattggaagtgtcaccatgattttgtatttaactcttacaacaattacatatgtaagtatatacaatatttctgtacattgccagagacattttagggcagtaattgtattaaaaccacatctactgtaaataatgttaggttcttttcatctcaaaccactttattcttgcctacttactcgttatttgcatgatagtttgtgaattatcaaaatacaacttaactctttaaa

SEQ ID NO: 1432 - DNA, 542 bp, Homo sapien
tttaagaaagagcctttgagaaacatgcatacttttctcttttctcctatattcaatactcatatagcctaaaagatggaaactggttcaagaatttaaatgacttgttccctaaaaagttaatctcctcacctttgtgaaatatatcaagtgctttctataaataagggcaggaaatgctaacttcataagcatagtcctagtcattaaaataatttgatcatcttctaaaatttaagtatgatagtaacacagtaatatggaaaatctcaatatacttaacacttcctaaacagcacaatgaaatgttgttcaaggtctgaattaatttgctacaggacctaagcaagtctgtttgcttatcttttggctttaaaattctttaagtctaaaatggtgataattttagaataaactgacaatgtggggaacaaacttaaattcacaaacactacccatatgctcaaaaactctctgggataattagtttcttcattgtaactattgatgtactattatttcatctttccattagctctact

SEQ ID NO: 1433 - DNA, 175 bp, Homo sapien
ttaaattgattcaaaaaaacttgacacctgtcatgtaggccacaaaatagtagcgaactatactaagtggtatagcccactgtggagtgtggtcttttactcttccaaatagcccaagttggcaaaggttacttaaaaacctgccccccaaaaagctaacttttggtagattttt

SEQ ID NO: 1434 - DNA, 90 bp, Homo sapien
ttaatcactattgatggaagcttatattccttatgaatatatacatgtatgcatatatacatctctgtatgaatcactcaaagcaatttt

SEQ ID NO: 1435 - DNA, 153 bp, Homo sapien
tttacctttgtgctttgaaggttctaccatttakaaagtaaaaagccaacccacagaatggaagaaaagaggacagactctaacaagcgttcacaaagatggagagaaattgtaaccctcatatattgctggtagaattgtagaaagatgcag

SEQ ID NO: 1436 - DNA, 483 bp, Homo sapien
  misc_feature (1)...(483): n = A,T,C or G
tttttagtttaaagaagagttttgccacttaracangggagctwtgtctggaaaatacactgagttgaaacacttcatccttggaaggattatataagatgaacagytgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagytttcttataatgttgaaatgttttagaatcctttgaatctaagtatttgtttcctaaatgaaacatttgtacaacatttgatgtttttacttatgaaatattctcctcccccaagaaaattt

SEQ ID NO: 1437 - DNA, 171 bp, Homo sapien
ttttgccacctcaagaagccattttcttgtctgtttccttctttacctacccctacaacctatgaacaaataccataacttaaaaatttaggtagtctacaactcctacaaattttaagttcagagactacccaaagaactgtggaagatgcagcaatataaaagtttttt

SEQ ID NO: 1438 - DNA, 408 bp, Homo sapien
tctgagtggaggtaggctaacaacacattttgactttstcctcaaaggatagctttgaaaaacaagtgtaaccaattgttacaccaaattaaaatggcaatattaaatcggtaacaaaacgatccacattttatacaatattgtatttccaaacatacataggtcatgaaaatcagagaacctaatatagcaccgttgaaaccattcattatccttcatgtgtgtatgcaattcagaatttcggcagaagacaacaaatggaaaatgcctttcgtttctataaatcattttggatttcaattaaatctttgccttagtaaagggtattcttatctcaagatcaattagccgtttttagctccaccgttttggaagtaaaaatgatgagctacatctactttttaattt

SEQ ID NO: 1439 - DNA, 168 bp, Homo sapien
ttacacaacagctataaacctgaacacatatgctatcatcatgccataagactaaaacaattatatttagcgacaagtagaaaggattaaatagtcaaatacaagaatgaaaaacgcagtacatagtgtcgcgaactcaaatcggcatttagatagatccagtggttt

SEQ ID NO: 1440 - DNA, 307 bp, Homo sapien
tttcacatacgaagaaatcaactgtgattatgaagtgacagccagctaaatatgtcttgtattttctctcttcctttttttgcctaactcatcctttacttccattcctgcttccatggtaatgcaggctcaaataaattactaggatacaagattacttcaagcctcttttctgtggaactcataatatgataagcatttgttacaagattgcctgtagttgtttaggggacaaattatattagggaaagaaagtctttctttagttggttaaattttctattataattgggtactaaatttattt

SEQ ID NO: 1441 - DNA, 684 bp, Homo sapien
  misc_feature (1)...(684): n = A,T,C or G
ttaagttctggagtgttcacttctgagcctgaattccctcccctgcaaaatgggggaataccctcctcagagggtccctgcgagggtgaggggagattcagcatggcaggtgtgctgggcacggcagggcctgggaagggcagatcctttccccatccctgccacaaacaacccaaacctttaaaggagagcaatggccttgtgtcaaaaacaaaaacaaaacaaaaccctgtcctaggagactggggccctaatttctaatagcaagcctttatgagtccctaacactctactgggctgagtatctcacacgccagaggataacctgccttctgctcaccaccaccccgtagtagttgtcattgtgtccatttcacagatgaggcaaaggctcagaagagtcatgtgttaaaccagcttctagagcccatgcaggagctgcaggtgggagaatcacctctaggtgctcttcccatagaatcctcacctcctgagtgtcactcactcagcttccaatgggtgtgtgacctttgaccagctttcttcctctctgggcctcagtttcccacctggacaaagtaagaggtctcttggcttcangtaagttcttcctaaacttctttttccttttcatttgagcatcctcttcatttttgccacctctctgtcatttacaggcttttt

SEQ ID NO: 1442 - DNA, 166 bp, Homo sapien
aaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaagaacaaagtttt

SEQ ID NO: 1443 - DNA, 194 bp, Homo sapien
tttgccctgtcaaaagaagagctaaagacagttatataaaaattaaggtgggctttcagactggctaacacaacaacattccatgagtagatggtaatttatttttgtttatccatttcgttgggagcaaggacaaaaatgtaaatctacaccttgcttatcaaaattgccgaaaaaagaatgctctgcctttt

SEQ ID NO: 1444 - DNA, 96 bp, Homo sapien
gagagtcgagagtgggagaagagcggagcgtgtgagcagtactgcggcctcctctcctctcctaacctcgctctcgcggcctacctttacccgccc

SEQ ID NO: 1445 - DNA, 365 bp, Homo sapien
gggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaggagcaggtggcagcaggggaacgtcttctcatgctccgtgatgcatgagggtctgcacaaccactacacgcagaagagcctctccctgtctccgggtaaatgagtgcgacggccggcaagcccccgctccccgggctctcgcggtcgcacgaggatgcttggcacgtaccccgtgtacatacttccc

SEQ ID NO: 1446 - DNA, 386 bp, Homo sapien
tctggaaagttcttgctcgggtcccttcacctccccgccctttcttaragtgcagttcttagccctctagaaacgagttggtgtctttcgtctcagtagcccccaccccaataagctgtagacattggtttacagtgaaactatgctattctcagccctttgaaactctgcttctcctccagggcccgattcccaaaccccatggcttccctcacactgtcttttctaccattttcattatagaatgcttccaatcttttgtgaattttttattataaaaaatctatttgtatctatcctaaccagttcggggatatattaagatatttttgtacataagagagaaagagagagaaaaatttatagaagttttgtacaaatggttt

SEQ ID NO: 1447 - DNA, 261 bp, Homo sapien; identical to SEQ ID NO: 288

SEQ ID NO: 1448 - DNA, 404 bp, Homo sapien
aaaaaaaggaaaaagttttattacgaaactagtttgtataaaacagggttatacatatttttgtaagtttgtaataaaacagtaagaaaaaaaaggcagtaatagaaatctccaaaaggcaacctatcaaaaccaactggctgccactttgagtttggacagtagctgcataaactttgttcttcttgaacagtatttaataacatcattaatacattaacaacatttctataaagtaagacacattggtgctgaagtacaactggtggcctcttgatctcacctatgaggagagttctttacaaaaccacatagggaaaattgcagttgtaaggtgaactacacatctaaaatatgcagaggtaatagcattacatgttaaagtatcaagatatacacatttt

SEQ ID NO: 1449 - DNA, 230 bp, Homo sapien
aaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagargcttcttgctgaattttgattctgcag

SEQ ID NO: 1450 - DNA, 194 bp, Homo sapien
aaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctatttt

SEQ ID NO: 1451 - DNA, 106 bp, Homo sapien
aaagatgacaaatactggttaattagcaatttaagaccagagccaaattatcccaagagcatacattcttttggttttcctaactttgtgaaaaaaattgatgcag

SEQ ID NO: 1452 - DNA, 349 bp, Homo sapien
ctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcattta

SEQ ID NO: 1453 - DNA, 302 bp, Homo sapien
aaaaataatgtgcaagagcatcatgagaaagaagaggggtgaagagataatccagaggaacatcaaatgtaagagtatacactcaaagacaggtttaagaaagaccagtcagagaagtaaagaaaaaaatcaagcaagaataatgttgcaaaaattaacaagaaagttgcaagcccagagtggttagcaatgccaaactaccatgagtaagccacataaaacaagaactttgggttcaactgctttaacaatcagacctttagattcacataacaggagttacaaaattaagagcctctttt

SEQ ID NO: 1454 - DNA, 268 bp, Homo sapien
caagcgtaaaccgcgggagccgagcccagctaggaatgcagacctcctgaaaaccaagccgaggactgcggggtccggtgtccacgcagagtgtcagcttcctctggtgcaaccagcaagtcttccagtatgaatcccacagaaaccaaggctgtaaaaacagaacctgagaagaagtcacagtcaaccaagccaaaaagcctacccaagcaggcatcagatacaggaagtaacgatgctcacaataaaaaagcagtttccagatcag

SEQ ID NO: 1455 - DNA, 207 bp, Homo sapien
  misc_feature (1)...(207): n = A,T,C or G
ctgtcgagagcagccctgcccaagawtgncgggtgggggctggtgccaacgggttcccaaggscctttcmactttkgaakggctggarttcttgggaaaccmaaacsktgactacctgscttttttcttgggcatygacstgcttcatttccaaaratgatggkgcaggtgaccttttccatcgtgagctaaaaaaaggttaggagg

SEQ ID NO: 1456 - DNA, 181 bp, Homo sapien
aaatttctgtctgctaaaatctatcaaatacattaaggaaaagtcccacttggcacatctcccacaccagatgttaattattcatactgcatgactgaggattttggaggcagagagagattcatctgcaatatttggaacaccaatggaggtctacgtcaacacagaatttatacagcag

SEQ ID NO: 1457 - DNA, 309 bp, Homo sapien
aaaaagwtcagagttgaaatgcctttcaaccattkccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgacttt

SEQ ID NO: 1458 - DNA, 117 bp, Homo sapien
aaagactattgagaaataggaaggtattgagagattattgggtttcatcakagcagacttaagtagcctggttgattttagatttgtcacagcaaaatcatgcttggatgctcgagg

SEQ ID NO: 1459 - DNA, 575 bp, Homo sapien
  misc_feature (1)...(575): n = A,T,C or G
aaagaatgcataccagaacatttataagcagtggagtgagkthtattaagaatagtactactacaataaacgctggctaaataagaagtgcattatgtgaagcactatgggtggtatatgcttwgmcacatactctkgttaccttgaggyagatmacrcatgkgaaccaacttcggcatacattttcagttgctgcgaggaatcatgtgttttaacgaaatgcgtcagtatgaaaaacttgaaaatattcatgaatgawgaacgcmttaggaaaaaaatakstattctcatgcaattatgtacagtctcactgtgtaratctcaaggcaaggtttgcctcctgtaaaccagatcaaggtgctatgagagancgccytgncttattgcatttcttttctcctmctgcgccagcattatattgctctagnctttatttttgtgtgcacactgacatgccattaaaratgangractatctcacatgtagaaaargaaagnmcttggankctacctcaggtcgctaccacgctaagggygaattctgcaggatatccatcacactggcggcgcgattg

SEQ ID NO: 1460 - DNA, 444 bp, Homo sapien
ctgggggttccttccttcacgttgagaacctggagcagagagtctaccaacttaagaaatattagaaagagttcagcaaacagagtgagctgaagtctaatcctagaagtaaatccattcctacaagtcatcagcatcacttgggagcttgttagaaaggcaaattcttggttcagcctaacacctactaaatcagaaactctgggggcggagcgcagcaatctgtactttcacaagccctgcaggtgattctgagcctgtaaaatttgagaaccagagctgtcccccaggagataaattaacttctacttttttttgagctactgcattttgggatcttattgttttatcagcttaacatgcatcctgatatgattactcaggtatgtttcaaccaatgttggttaatgtattatccccaggaacttattactagaggagcag

SEQ ID NO: 1461 - DNA, 536 bp, Homo sapien
ctgcaaccctgggactgaccgggaggctctgattatttacccmaccacaggtaggttgtgttctgaatctcaggttcacaggttaaggttcagcatcctcatcctccacggggttggagttgttgctggtgatgaagggtttgggtggctctgcatagactgtgatcgtcgtgactgtggtcctattgaggccactggctgagttattggcctggcaggtatagagtccgctgttcttctcagtgatgttggagataaagagctcttgtgtgtgttgctggatgttcccatcaatcagccaagaatactgtgcaggtgggttagaggctgcatggcaggagaggctgaggttcacccctggacggtaataggtgtatgagggggaaatggtggggkcrtcygggccatagaggacattcaggatgactgrgtcgctgtgstyarcacttaatkcgttctggattccacactcatagggtcctacatcattccttgtgacaytgartagagtgagggtcctgttgtcattggacagm

SEQ ID NO: 1462 - DNA, 409 bp, Homo sapien
ctgakagaccaggagaagttccagatgcagagactgtgatgctcttgactatggaattattgcggccagtagccaagttagagacaaaacaggcataggtcccgttattatttggcgtgattttggcgataaagagaacttgtgtgtgttgctgcggtatcccattgatacgccaagaatactgcggggatgggttagaggccgagtggcaggagaggttgaggttcgctcccgaaaggtaagacgagtctgggggggaaatgatgggggtgtccggcccatagaggacatccagggtgactgggtcactgcggtttgcactcactgagttctggattccacatacataggctcttgcgtcatttcttgtgacattgaatagagtgagggtcctgttgccattggacag

SEQ ID NO: 1463 - DNA, 502 bp, Homo sapien
ccttcagcctggatcctttatattaagatcaatgaggaccatttctggaagatgtctggcatggtacagactgtctgaggccractgaacacaggcccttaccctgattttatcagtgaaaagctatgggactagtttccttacctctaaaatggagagaataatagaatcttccgtctaagactkctgtgagcataagccgagaaaatggaggtaaactgcttagcccaatacttggattatcgtaaatattcagtaaaactagccaccgttgttattgtaattattattttgtattttattatacatttcatggaaacttaaaagttagtgataatcacctcattttcagttgccttgctttcttcctgtaaattttattctctcttatcttgctcactgtctttaagcattgccagtttagtataattattttcccctatcctctataaaatcatatacaggatggatttgttgatctcagacatgttcactgagtttt

SEQ ID NO: 1464 - DNA, 294 bp, Homo sapien
ggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcag

SEQ ID NO: 1465 - DNA, 249 bp, Homo sapien
gtgcaggtcttcagccgtgacccggtaccccagctctaagggaggtggcagcatcaaaggctcccctcgcctgcgtggcagcaggggaatcttgcgtctacggggcctagagtcatgggatctgggggagccacccctgggggcaagtgtctgccctggtgctgtacctgccttgttttcacagcggtgacccgaagagacagcctgaggtccgtcctcactcactgtgtttgaggaactgtgggccag

SEQ ID NO: 1466 - DNA, 203 bp, Homo sapien
cctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctatttt

SEQ ID NO: 1467 - DNA, 223 bp, Homo sapien
ctgtcagaacaggaacgacctgggttatggaagcccagaaagggaggaggacttcttttggtcccagtgaaagatgcttccagaatctgtagccttacttatttgcttggatctcactggaataacttggtggtgaggtcaccggttctggggtgatcactgggtttgctgcatagatgtttggatagatgacactcacattgcttgattgacagcagaccaa

SEQ ID NO: 1468 - DNA, 177 bp, Homo sapien; identical to SEQ ID NO: 1326

SEQ ID NO: 1469 - DNA, 185 bp, Homo sapien
ctgaagctgagaagtagcctatctatggargagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagctttttt

SEQ ID NO: 1470 - DNA, 482 bp, Homo sapien
ctgaccaggagggacggttctgtggacgaggacttcgtagctgaggagccagatttctttttggtcccttcctcctggaatggaatcgtggcgctactgtggagatctgagttgatgtagcacctgcttcctcggatgtagtccgcaccccggaccagatgccgctcggtcgtgggtctggagaaccggtatgggggagaggagctctcttcaatgatcggaggaatccgctcgttactgaaataccggcaaagggcatcctcccctttcctgccatgacctcgaggtctggcaaaagggtccacaatccccatccagttcccatcagcaggcatggacaaaggccgtggcttgccttcagagggacgagaaagaaggtgacaagtttgatgagttctggaactttagtgaaccgttccctttatgtataacttagacctcacaataccacacccacttagacagaagcaataacaaatttt

SEQ ID NO: 1471 - DNA, 257 bp, Homo sapien
tgtgtgaacttagactkwtcaattcaacatttttaacrtatkaaatactattgtgaattcaatgaagtgttcttatgccactaactttaacctattcccttactcamggatgtaggyaaargatggtaacaatacactattkggcaagataatgtmctgacatmtytagcaatsttttttgmcagtggcttkcaactgmamwkaaskkammkaatattgytkctgtwsgtarattattattctgwywytaatcattt

SEQ ID NO: 1472 - DNA, 342 bp, Homo sapien
cttttgcgagcctctgccgcagcagctccgttttcacgcgcatctcgtttttgtgtgtgtgtttttgttttgtttttgtttttgtttttttgtttcagagaattggaagctaaagctaccaaagacgtagaaagaaatcttagcaggtaagatgggcgagctttccgtctcccgccccacgataatcgtatatttctactccgattcgccctttctgggttgagaagttcccccgtgacattttcttccgcacccggagagcagacattcgggagaagcggcctgggggaatactggagggattgcggggagatgcgtaattacgcgtgtgtttctttcttt

SEQ ID NO: 1473 - DNA, 526 bp, Homo sapien
  misc_feature (1)...(526): n = A,T,C or G
ctgctacatgtcttcacagcccaggaattcaaggcccaggtggcagcaggaagaaacagtggaaaagcaaggggaagagaaaagagaaaaaggagggggaaagtctgcataactgtcataacctctgcttctcctgctctgtaacaaacccacaaccaggaagagtcatggtctggaacaatcatgggaccccaaacgcctgtaggttttttaccaccaaacatcacccatggctgctctaagctgtcattttgttcccacagttacctagcatcacggatgcccaatttatggcccaggaaggctgacccaggctaagggcagtctcactccacagccatgcaatggacagtctgaatgtttcctaccccagacctttactgacctctactatttcctcctctgatataaaagaaaaacacttttaattttctnctgcatnctacatctcctnctaaaaantttggcctaattgncatcaaaaccttgtaggaatctgaaattttggttcttctgaatcttancc

SEQ ID NO: 1474 - DNA, 187 bp, Homo sapien
aaacttgtttgctgtgaacaattgtcgaaaagagtcttccaattaatgctttttatatctaggctacctgttggttagattcaaggccccgagctgttaccattcacaataaaagcttaaacacattgtccaaaaaaaaaaaaaaaaaaagccccykcccsgggggscckttmaaggggraawtccc

SEQ ID NO: 1475 - DNA, 474 bp, Homo sapien
ccattctctttatctcaaaccgaagaaagatatgatgcaggcagtagttttttcttagtgcctcatagtatctaatagcagaaagtgagccgcatagcggagcacattagtttttatgtatctacaggacagaagggccacttagctgatggctccaggtttcctttgatataatctaatgttcctatgacctcaaagactgaacacatttccctaagtgcttcacttagcacccaggagcaacttggagtcttcgcagaataaaatccattattttaatgtagattaatacatgggtacttatatctatgcaggtctataatagtttattcctatgtaagctttattaaaagcattggtatgttttacataaaaagttaatgtgaatattagaaaaaaaggacaatattaaagcagtttgtagaatttgttccccccccaaaatgaatgaaatacacaatagatgtacaaaaa

SEQ ID NO: 1476 - DNA, 401 bp, Homo sapien
ccttggggacagggcaggaggacgcacacctcatggacagggcggccagggctgagataccagcggggtgggtattcccggcgggtgcttacctccaacagtgtcttgtcagcaaaggccatgatgccctcaaagatgatgacgtttgcaccatacagtgttttctgtgaagaaacccaggagttgcggagcctggctcatgtgcctgcagccccccgaggccccctctgcagggccctggcctacccagtccttcttccggctgtgcgtggtgaagtcataaatgggcaccttgacactcttcccctgcttcagcttcttgagggtggaaatgatgaaggtcgaagtcaaaaggcatctggggtgggtcgaaagtttgaaagtttgcttgtggtgccggg

SEQ ID NO: 1477 - DNA, 753 bp, Homo sapien
  misc_feature (1)...(753): n = A,T,C or G
cagcatgcttaaaaagttggaggaattggaacagaaatacacctwmcaacctkrmcctnttaccaaaaacaaacnagtggtatkggamccsacctttmrkctttttcmacmacttatttcaaagytsrttkgtggkgaaaagmcacycyksnatscywccrcacccttgwaggcygttggacttrataacakknctgctnatnwntgtgaggggtgataytgatgrtgaaattgcacttagctgggttataattkgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggccggaacccaggaacctgtccttcttcctgactcccccttgtgcacgatgggctcancttttcanaagtgcttgagttggcagtttttcttnttgtcacccaaaagaaggtctcaatggngggacccanaaccttt

SEQ ID NO: 1478 - DNA, 421 bp, Homo sapien
  misc_feature (1)...(421): n = A,T,C or G
aaacctatactcactttcccaaattgaatcactgctcacactgctgatgatttagagtgctgtccggtggagatcccacccgaacgtcttatctaatcatgaaactccctagttccttcatgtaacttccctgaaaaatctaagtgtttcataaatttgagagtctgtgacccacttaccttgcatctcacaggtagacagtatataactaacaaccaaagactacatattgtcactgacacacacgttataatcatttatcatatatatacatacatgcatacactctcaaagcaaataatttttcacttcaaaacagtattgacttgtataccttgtaatttgaaatattttctttgttaaaatagaatggtatcaataaatagaccattaaccaanaaaaaaaaagaaaaaaaaaaaa

SEQ ID NO: 1479 - DNA, 214 bp, Homo sapien
ggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttccttttt

SEQ ID NO: 1480 - DNA, 434 bp, Homo sapien
ggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaa

SEQ ID NO: 1481 - DNA, 131 bp, Homo sapien; identical to SEQ ID NO: 1366

SEQ ID NO: 1482 - DNA, 324 bp, Homo sapien
tgctcgctcctcagaggctgaaaacatgagaagctaggtgtggtgaaaccaaagcagctttattgttcaaatgctaaagacgggaggatggactggctcaagccttaaagaaaccatctcgactttttgaactcagtgaacgggtttaaggaaaacgtgggaaatatgcaaaggtggtgcaggagggtgcaggtctgtgtgtcttattcccatggatatcttgagtaatcgcttgtccagaggtggggtttgtgtcatcctgaattcaacccagcaatggtagggtactgttcataactcaccctaagccagaagattcctcag

SEQ ID NO: 1483 - DNA, 393 bp, Homo sapien
atgtttaatgaatgatacaggatacatccctgttggaagcttgcaaaagacacatacactgtggtacatatttgatttaatagaagttgtttatcaggctatatatatatttgcccaaacatgcaccacaggataaaataactatttacataacatagggtatttaattgacatagactatcagctttgctgagagcagaagatggcaaagcaatactgcagcagaaagtggaacaactattctaaagcaatactttagatatatttttctagaatggatttattagattactttttggaaagcatttgacctaaattaaatatagagctctgaaacttagaataaaatttgcacttgctgaaacagaatactttgcataaaaataatccttt

SEQ ID NO: 1484 - DNA, 323 bp, Homo sapien
tttagatcagaaagtttgaggtcttcatcagcagacactcgtgcttctatttttcttgttttatcgaacagttctgaaactttgagaaaaaacttgcatatatctgtagaatcctgagttcctaaagcatataatgaagaaccaattctattgtaatcatctgcagcacttttgtgggatcttgtcattctatcagatttagcagatgcatccttaactcggttatgatattccaaaagaaatgttcgttcgtgctcaaagaaatcatctacatcctttactcctgaaacgattactccatctgctgatttaaccatgttttt

SEQ ID NO: 1485 - DNA, 405 bp, Homo sapien
aggagcgtcaggaaaacacgggcagcctgggctctgacccgagccactccaactccacggccacgcaggaagaagacgaggaggaggaggagagttttgggaccctctctgacaaatactcctcccggagactattccgcaaatccgcagcccagttccataacctgcggtttggggaacggagagatgagcaaatggaaccggagcccaaattatggcgaggccggagaaacaccccgtactggtacttcttgcagtgcaaacacctgatcaaggaagggaagctggttgaagccctggacctgtttgagaggcagatgctgaaggaggagcgattgcagcccatggagagcaactacacggtgctgattgggggctgcgggcgggttggctacctgaagaagg

SEQ ID NO: 1486 - DNA, 230 bp, Homo sapien
aaaaatatgtggattgtgcttgacgtagcaaatttcttctatctgcaaaagcccttttctcactacctcatatacacccctttgatatggcaccatgtttgaaattggagcgtacacacatagtcattggatttactgggattctctttgtgacaagtaggagccaaggggtcatgcagggaagcgaacgtgcccgataaggatttccttgttgccagagtgtttagcag

SEQ ID NO: 1487 - DNA, 273 bp, Homo sapien; identical to SEQ ID NO: 1424

SEQ ID NO: 1488 - DNA, 452 bp, Homo sapien
cctactgtgccccgtaggcaaagctctgaagatttcatcgaaaaatctgctgtcaatacgtagaaaagttcactatttcagtttcacagcaaaaaaggtggggggaggggggaacccaatagatatttaagtagatgctttccaatcccattcactgcattaattagcttacctcttatacagtacaacataaacattgcatgtttatttgtatgtaacacctataagcatatagcatctacattttaagtgtatttacaaattcaacaaaatatctacatataaaaagctttacttaaaattaaacttgatgcaagttatgagaaaccaatttattggcaaatgaaactgagcattccttcaaccataggttgttatagattttcatatttggaggtaacccatttgatagatattgtttatgaatacgatagaatatatatttacttttt

SEQ ID NO: 1489 - DNA, 653 bp, Homo sapien
  misc_feature (1)...(653): n = A,T,C or G
cctgctcttctcttcaaagcacttagtacacagggktacaggtgctaccacttggattccccagagcatggaagtctgatcccaggttgaacatatttcttctgaaaatgagcatcttggttctatagattcttatcttgctcacaggacttgctccaaaactgaattttcagaagcagcatgatagggaaagagatattcaactctgacagacaaggtagatcgaagcacccacactaatttctttcaggtgccccatgaggaagactgcatcatgtcacttccactcacttggggagattctaggactgagacacaaagttcccccagagtttctgctaatggaaggggaaacaggtggtttggaatggaaaggtggaaccaggtccacaaaatgtgctccctctgctcaagactgactttggctttcccaggtccccacttgactttcatataagctgagatgacctattacgggaaaaattagggaacacctaataaaaccaactttcaaaaactcctatttatcatggatgtgccacgatcgagagaatcnaacacnaactgnctgtnagagaggccttcattntgnctcatcttgagctaaaatcctgrcttgggatgccagaaancatgnccctcttntcggtttg

SEQ ID NO: 1490 - DNA, 363 bp, Homo sapien
  misc_feature (1)...(363): n = A,T,C or G
taacctgacaaaataaaacttagtaaaatctakaactgtttcttggcctacttgagaggaacttccatattttcacagccatctccgaaagcagcagttgctgtaaattaactgagacttggaaatggtgcagactgtcttggtagagctgttcttatagcacaattttatctggaaaataaacttgtaaatgcgtgctgtatattaatacatgtgtgcccatatttatttttattatctcctgccagtctttgctcaatgggagatgacagaccaacttctcaacgtgatttccccatttcattgaatgagatttatatgccacttatgaaaaaaaatactgctgngaaagaaatgtacttt

SEQ ID NO: 1491 - DNA, 163 bp, Homo sapien
taatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagtttt

SEQ ID NO: 1492 - DNA, 184 bp, Homo sapien
yattccccaggggaaaaattgaaagtcaaactattcaccaagagaatgcattgtctttgcaaatgagcctaagaatcagactttttataaatacatgttcaagtttcttgtggttctaaatggacactgagaactgaaactgtctacaccaagtttacaatctatattaactatcattwtacag

SEQ ID NO: 1493 - DNA, 273 bp, Homo sapien
  misc_feature (1)...(273): n = A,T,C or G
aggtaawttgtgatatttagtgcacatttacgtgtaggnccrtcttkaatggtaaagacagatacaagcctatggcacacttctccaaagcaagctatacttgagagccaattcccaaataagacagcagagatctgattaaatgcaactgtgcaaacattcaacagacatgttgaatgtaagacaaattatgattactgataatatgcaaatgtggtctataaatttatgaatgtgacttccaaggggaatatggtatggaagcccattttt

SEQ ID NO: 1494 - DNA, 343 bp, Homo sapien
ttggaaagcctatcactttctctcttcattctccagcccccacaccaagcacacagagcttttcagtgctttactcttaatggagaacataaccagggattatcaggtattccaacatgaaaaagaaagtccaatagaaacaagcaggataatcaaaccaggaggaagcagagactatatagagaaagaaaaaaagacacatgggaataacggcaataatactgacaatacacctcaccataaacttatcagaatgaatttgttggagaaatatatggaggggaggtacttgtgtgtgtgcacaggcactcatgtacacgtgtgtatgtgtatgtttttttaa

SEQ ID NO: 1495 - DNA, 378 bp, Homo sapien
tagcattcttccagccactctggcgtcactatgtgcttcacgacagaaatcgccgtcaggaacttcacggtgcgagtcactttgctggcaatgaggtgtgtgcacttctgtgcagactccgcaacctctccaccaagaatgtagagcttcttaatatactgttgaacctggacaggctcgaatccagtgaaaagcacaaaaggggtcaattctggagttagctttttagtgggaggtggtacgtcttcaattctggctcttttggaagaaggctggacattagctacttcattctgtttcagtttgggaggtagtcttatactcatcaacaactctgcagacacttttaagggaactctccaagcatctaaaagattt

SEQ ID NO: 1496 - DNA, 181 bp, Homo sapien
tggagaaggaagttttcctgaagagccagaatccttgctaagtcatttagatccaactgaccatctttatttctgtcaaaaatcttcatcatggtgccagtgtattcttccagtttagcctcagaaatggcctttttgtggtgaagaaagaggtctcggaggaagttgcggagctcagcag

SEQ ID NO: 1497 - DNA, 373 bp, Homo sapien
tggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggacggcggctccctggaccaggtgctgaaagaggccaagaggattcccgaggagatcctggggaaagtcagcatcgcggttctccggggcttggcgtacctccgagagaagcaccagatcatgcaccgagatgtgaagccctccaacatcctcgtgaactctagaggggagatcaagctgtgtgacttcggggtgagcggccagctcatcgactccatgg

SEQ ID NO: 1498 - DNA, 337 bp, Homo sapien
gctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatgg

SEQ ID NO: 1499 - DNA, 314 bp, Homo sapien
catgcggagggactttagcatggctgataaggtccttcctaccattccaaaagaacagaggaccagagttgcacactttttggaaaggcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttgg

SEQ ID NO: 1500 - DNA, 321 bp, Homo sapien
cctgaaacctggtgggaagatgattgaaagtgttttagattcaacagattgactatgtatgacttatctattaaaatgaagaacttccatggtttaatagaatgaatgctgtattcaacaaggtcttccatccttcttataaatcttaagactgtgtttaagctttctttcacttttactctatcccttggaagttaattgggaataaaaagatttatcaatttagtcactataatttaaggccaggcatctgcttggaaatacaataaccacaattaatacttagagaaaattgtttcaacagattaactctgctatttt

SEQ ID NO: 1501 - DNA, 557 bp, Homo sapien
ctgctctggggaaaatggtggaggagccaggcagagaggaggagcagagtgctggcagtggaaagcctagctgagactggagatgcccccctgcccaaagcatctcagcgaggatgcttctccatatgggtgagccagcctagagacagaacaggggaagccagcgggtgctgcagcgacccaccgccccagaacatctgcatcttacatcaacaaaggtttatttctcattaatatccattgtgggttggctgccactctaaccctcgttgcctctccatctgggtcttgggtggcagagcagcctgtctctgtggcagaggaaaagagagcactgggcagcacaggctgactctcaaattttccgcctgaaggtgacccaagtcactgctcacatttcattgactaaagcaaaatcctatgcctgtgggtgagttgagcaacgtgatgaggtgttaacttcctacagggaggggctcaaatattgcccaacagtggtatggcccactgcctggggtggtcggtggaaggctggcaggacaagggagaccacgtgg

SEQ ID NO: 1502 - DNA, 249 bp, Homo sapien
cctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtgg

SEQ ID NO: 1503 - DNA, 302 bp, Homo sapien
ccaggacctcttttgggcatttcttcctaagtggaatacacaacagataagggagtaggggaggtaatacagggaagctactctttccagctcagaaggagttgatgaagcccatatatgcattcaagaagcccatgggatcctctagctgtggatagtggctaatgtggtcatccagaatcgacactgtggaccgcggcagcgttttcctgtacagctccaaaaactctggatagggatttacaggatccaatggcccatagataaaatgaatggggatagttacagaggcaagagctccc

SEQ ID NO: 1504 - DNA, 430 bp, Homo sapien
ccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattgg

SEQ ID NO: 1505 - DNA, 164 bp, Homo sapien
ccagtcaccttcaccttctaactaactagcctccggatgaggtggctgccaccaggcccgaatgatccccaggagcccagcttccaaaccccaacatcgaatcaaacatctccatccccaagtgcagtaacacacaaaaaccaaacactctgccctgggaaagg

SEQ ID NO: 1506 - DNA, 189 bp, Homo sapien; identical to SEQ ID NO: 1413

SEQ ID NO: 1507 - DNA, 268 bp, Homo sapien
ctgcacagaggggcacggaactccaaatcctggaatgcgggtcaataatgtgaattctggccctgaccgccagacacacagcaagcctgagtcatctgccgtcaccatgtcagccacacaatcctgtccctgggcaggctcggtggcaatgtctgtgattggcatctggtgcccagccagctcctcgctcagtacaatgttgggaccctttgctgggatgtcaaacaccagcacccggcctgaccacgttcccacacagatgaagtgg

SEQ ID NO: 1508 - DNA, 159 bp, Homo sapien; identical to SEQ ID NO: 1342

SEQ ID NO: 1509 - DNA, 234 bp, Homo sapien
ccattgtggagtacattatgaacacaatgtgcttgykaagtcttctctctcattttcagacagcaattgttaagagtcacacacacgtcccagacctaagcagcaactccagtgaatggtactcagacacactcacgggacagcacagaacttgattcttctttgtctgttgcccaaagaacctgttctttgagtctgttccaggtgacttgtaatgatacctcttacggtttt

SEQ ID NO: 1510 - DNA, 437 bp, Homo sapien
aaagcagtacatcttaatatgaagacaggaatttctatgatgcttacgaacattagactcaacatttttgcagccccctttcctggtctacattcacacaaacatgagacacagtcccaagggagaaacagatgctggaggagcatttagggccagagtggaggcacagaggaagctgggatttttcaactaccccctccttggttactcctgggattcccttaggatttcacggcacaaccagcgaagagtttgctcagattcacttcggagtagccacttcgggacaagaattgctctgctgtgttcttgagttttctgtagtcctgcagaactttgggggtaaaaaattgcttcttcaatttatctttctcatgatcggtagtaagtttctccagtgcacactccgcatcaaaaatgtaccggtaaaagcacag

SEQ ID NO: 1511 - DNA, 94 bp, Homo sapien
tgtgaagatggagtctgaggggggtgcagatgactctgctgaggagggggacctactggatgatgatgataatgaagatcggggggatgaccag

SEQ ID NO: 1512 - DNA, 493 bp, Homo sapien
aaaaatatgcattacaactggagttttccactgagaataagagtttggttttgacctcmcataaatccaagggttcttgaaaaaaaagttaatataaattctcaataactatatcattaataccttatgtatacataggagtttatataatgcatttaagtaacaaagaatgtaacatttattagccaccaagtaattaggagatagcatcaattatattgaaagaagatgagtttagatgcttatagtcaagggagttaattgaaattgaaagctattgtaggtggttactactattattatcaaacctgaaagttggaacatgtgaacttgatcctttgcacacataaaagttcacaaagctgcttttaatttgcctttgttctgtagtactgcttggtgaatcatgcactagtttgttgtaaaattcatgtaaacttttatgtatacaaatgtcagatcaagcacaggttttattaattatatatatttt

SEQ ID NO: 1513 - DNA, 510 bp, Homo sapien
aaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcagagccacattatttctagtccaaaattacaagtaatcaagggtcattatgggttaggcattaatgtttctatctgattttgtgcaaaagcttcaaattaaaacag

SEQ ID NO: 1514 - DNA, 511 bp, Homo sapien
  misc_feature (1)...(511): n = A,T,C or G
ctggagatcaggaatagaacctttccaagatatcataatattttctttataggaacactgagtaatggcaagaatattttgagcttttccatggttaagagcgatagtctcagaggctggagaaaatgttcattctgctcagtgatccaggagtgtgaggacagtagcttcctttccacgtccacaagacaatgacagatgtgtttccttctttgccctttctagggatctttctagggatgttgattctctcacaatatttcaatgtcccatttctgtgtttcttctccctccaggggctgatttacgattacatgagtcttgtcacaataatttcctcctttaacatcaaggacaagttgatcactgagataagagctgatagttccatttttattcagtctccacttctgcctgaattgcccatgttcagtccatagagctactttagctccaggtgtggtcccggccnccatcacatcaagaactggtttcactgggccttggatta

SEQ ID NO: 1515 - DNA, 176 bp, Homo sapien
aaaggggaaggkgaracttaaaagtattcccaactagattatctacaccaatacattggaactctatattttgctttcattttgtcttaaaaaaatgaaatagcaacgctctatcagtcacacagaggacatgcaratttagcagtattgatattatactctatcttgttggattt

SEQ ID NO: 1516 - DNA, 309 bp, Homo sapien
ctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacaccgtgtactccctgcagcagttcgggttttcagagaaagatgctgatgaggtgaaaggaatttttgtagataccaacttatacttcctggcgctgaccttctttgtcgcagcgttccatcttctctttgatttcctggccttt

SEQ ID NO: 1517 - DNA, 182 bp, Homo sapien
ccaacatctaatttttttactttttaattatagctgttgtgactgatgtgagatggcatcttactgtggtttttgcttgcatttatttatttgatgattagtaaggatgagtgttttttcatatacttgagtgtcttcttttgagaaaatatctgttcatgtcctttgccttttcttgattt

SEQ ID NO: 1518 - DNA, 548 bp, Homo sapien
cctgagggagagggaaaagcggatacccacctgtgtcgctgtttgcgtgccaagtccaggaacagtccatacagccctgctgcatcccacgacgctgtcacaaagcaggagttcatccgaggccaaggtgttgtcatgagaatattcgttaaagtagggacgctgactttgttcttgggcagattctcttcctgtggagtatccagcctgtttgcctagttttcctgttcttctggggtctgatctctatctgttttactgcagtccagttaccaaagtggtataagtaaaattgaaagaattctaaataccttttccccccacgttagctgcctcacgttaatgtggtcttacggtctgcaaataagtgttttgatgatttggcgactgcagttacccatactagctctcctaccactcactactgacagttaattattatcgaatatccacccacccagggtgagttataagttataccaggtgttttggttaataatactaatgcaattaatttactggttactctctcatcttaaagtaatcag

SEQ ID NO: 1519 - DNA, 491 bp, Homo sapien
ctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctacttgtcctcggactacgagaggtcagagtgggagagaagcaatttcagaaactacagaagaaaggatcttcagg

SEQ ID NO: 1520 - DNA, 169 bp, Homo sapien
ctggtactgtcgatttggaaagctggctggaaaaaacttattcatgaaggggctgatggtgtgggacagggccaggattcccagcacgaagaaatacatggacagcaggaggttgatgtactcctgggagaatattttgaaaaagaggtagagccccaagagtgtgcag

SEQ ID NO: 1521 - DNA, 293 bp, Homo sapien
aggacgacgctgtcrgargcagggagagcaaattaccacagcttcttggcccagttctgcccttctttgctttgggattgcactgggccatcagctcatgccaggctatgggggcagccagttggcattgctccccagactgaacagaaacctggccgccggatgggacctcctttggcacagacttgactgtgtaactgcataaactgcagtagcatcattgccctagatgccccaggagacctggcaccatgaggattacagacagtggaatcttactgtcatctggacag

SEQ ID NO: 1522 - DNA, 386 bp, Homo sapien
ccacgtgggactttgaagacagcacaacacagtccttccgctggcatccgctccgggccaaggcggagaaatacgaagacagcgttcctcagagtaatggagagctcacagtccgggctaagctggttctcccttcacggcccagaaaactccaagaggctcaagaagggacagatcagccatcacttcatggtcaactttgtttggtagtgctaggagccaagaatttacctgtgcggccagatggcaccttgaactcatttgttaagggctgtctcactctgccagaccaacaaaaactgagactgaagtcgccagtcctgaggaagcaggcttgcccccagtggaaacactcatttgtcttcagtggcgtaaccccagctcag

SEQ ID NO: 1523 - DNA, 178 bp, Homo sapien
aaaaagcctatcccatactgaattgtgggaacctatgaagtgtctcttaatgtcaattaaaagtaacagtggctgcagatattgatttctgaaagtacatgagaatttgtctctaactatggttgaaacaacaaaaccaaatctgaatcaggtagaggtctaccagacacaaactctg

SEQ ID NO: 1524 - DNA, 319 bp, Homo sapien
wycacagcwgaaatggggcactgaagtgtggagscacakaatgcgggagggcagaaccacagacaggaggctgagattgacctcctgagtgcaagctggtctccccttcacctcctgcaccctacgcagatggtgcttaccataggattgccgtaaaacagagacacgcaccagcgagaaactttagcccttagtatcccatcctcaggacagaatcactcttaaacatgttgaaatacatctgcttagagcttttctatgtgtctatataatgtatgcataatatacaattagaagcatgtgattttataacattttt

SEQ ID NO: 1525 - DNA, 467 bp, Homo sapien
ccagactagacagagatcaggtcatcaggggagcttccgagcttcagcaaagcccacaggtagctctgcgaactcagaatgctaccctaccttccctgcaggccgctgttcatgtctggactcctgggggcgctatttaatgtttacccccatctccagtgccccctccaaggctgtgcagtgtcttggggctctcagggccaacatcgaagagatgggggccacctcttaacacctggcaacagtctcccctcatcctgattcctgacaacagacaaaacaccggtttctagggtttatctgtttgttttttgagttgagggttcctcagggccttggcattgctagtgatggtcccctttgctgtgtgagaaccccctcaaccccttcctcctccctctggggatgaagtgggagtatttggctccccatttttgacaaaagggctcagtgcagggaggtggagg

SEQ ID NO: 1526 - DNA, 439 bp, Homo sapien
aaactgtttactggagaaaatcctcgctcatgtccatttattgtttttttctgtactgtgatttgtttcaagcttaggaaaactagtatattagagtatgttctaggaaattaaaagatctggttagagtaaaaagttctttttaaggttcttaactaattttttcacaactaagaaaataaatgaagtattcttaggctgaaattcatcttattttatcataaattagattgtaggggcagcctacatttttgtgtatgtgtttttatttcttaaatgattgtgtgagcctggtgacattttatggttcttgtgatctaaactgtttttccaattcacatcttttgtcgtgaagtgatattatactagagtactgtttgcattgtaaaaatgctttgctggtgctctggcattttgtctttatctcatcacctaattt

SEQ ID NO: 1527 - DNA, 609 bp, Homo sapien
  misc_feature (1)...(609): n = A,T,C or G
ctggagaacttgggctccattaggtgcaatcgttggagtaattagcccatcttttacatttcttgccacaaaatctcgaagagctgccatttcaggttcggacagtgaatacacatgtccactgggaatactgtgtgctccaggtatcatttctatgtgagggtcaaccaggcggtgatctgggtagacgtgctcatctactggagtgtacacattctggacatagtaatacctcactggttggtaaactctgtatccatctactggataatagagtggcggttgtggtgctggtggtgggagcgatggtggtattggagaatacatccggcagtggtagcggcagtattcagaatcaaagacgatagatcgagtgctccatgtgatattgggatcatgtgtgctcagccagcgaacccctaggacgacagggaagaatggagactgagtcacatcaaatgacagcacctctcggtgatctcccaggtcaactatcaggtcgtgagtttcgtggacaactgggcccgatgctatggggcgcccatcaattgcttccacaagtattggacccgcccgggcggncgctcgcaagggccgaaattccagcac

SEQ ID NO: 1528 - DNA, 393 bp, Homo sapien
tgatgtaatgaattcatatttattgatacagaaaaatatgatataatccatctaaaaagcaagttacaaaacagtgtacagtgtaccatagtacctatgaacacaattagtgaagtaatttgcagagctataataccaaatcagaaattattttggtaatgaatttatgattttcctcgttttctgattttttccatgatctcatatactttattctcagaaaacaaaagacaaaaccccacacatacacaaaaataaacgagtaacttctttacaaccccagaggctaagtcagtgggaaaagagggaaatgaatggttatgagcataaacacagggacaaataaaagaagtttggagcacagagaacaattcacaaatcagaagtcatttt

SEQ ID NO: 1529 - DNA, 143 bp, Homo sapien
atccgatagaatccagttcaatgaccttcagtctttactctgtgcaactcttcagaatgttcttcggaaagtgcaacatcaagatgctttgcagatctctgatgtggttatggcctccctgttaaggatgttccaaagcacag

SEQ ID NO: 1530 - DNA, 636 bp, Homo sapien
  misc_feature (1)...(636): n = A,T,C or G
gtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggnttgtacaaaatctttgatgagattctagttaatgctgcggacaacaaacaaagggacccaaaaatgtcttgtattagagtccaattgatccggaaaacaatttaattagtatatggaataatggaaaaggtattcctgttgttgaacacaaagctgaaaagatgtatgtcccmnctctcatatttggacagctcctaacttctagtaactatgatgatgatgaaaagaaagggacaggtggtcsaaatggctnttgagccnaattgtgtaacatattcagtacccaatttactgngggaaacagcc

SEQ ID NO: 1531 - DNA, 194 bp, Homo sapien
aaaaggcagagcattcttttttcggcaattttgataagcaaggtgtagatttacatttttgtccttgctcccaacgaaatggataaacaaaaataacttaccatctactcatggaatgttgttgtgttagccagtctgaaggcccaccttaatttttatataactgtctttagctcttcttttgacagggcagg

SEQ ID NO: 1532 - DNA, 300 bp, Homo sapien
ccatacaaggtaattttgacaggttcctgggattaggacatgggcatcttgggaggccactactggcctaccacaactgggcagcaaaactattacaccctccggtataatagttttggtgtttcaatgactgggaggaaaagggttggaattttttgctttggggtccctcttaaccttgtatttttaaggtctgggactcaccaaccctccccttccaaccagagaaactcactgcagtatctccttgaaagtctggtgacgagtctgtctaagtgctggtgagaggcacaggaccaa

SEQ ID NO: 1533 - DNA, 521 bp, Homo sapien
gttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagatgtctccccatccccattcggggctgacgatggggggctgatggctgcccctgcgtggcctgagtcctggtccctctgaggcagttgacggggcagtcagattttt

SEQ ID NO: 1534 - DNA, 181 bp, Homo sapien
actcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcag

SEQ ID NO: 1535 - DNA, 544 bp, Homo sapien
aaaataggacactaaatcctactctgaaaggtggtttgatcaggactaaagagaatgtatgtagagtgctttgtgcaacgaattgtggggagcttggacccaataaggtagccagaattacccacaccatcatcatcttcaccaccatcattattgttatcgacatattccaatacacttctgaagggctggaagagagaaatatgtttgtgcagacaggcggcagcagtatttgatccaccaccacagctccaccgcttgggggcagtactgatccacctgtgctcccctccctgccccagcctggaaagctaatttcagactcaaaaaaatcaagtacagagcagcgcacccactccaatgagtcatccccgcccactctagacaacagcatgctcatgactcaaactatcttcgtgaatggttcaaaatatcaagaattggtttccatagtttcttgactaaccagacacaaaatttcccctacatgcagagattcatgtctcaacttcaactgtacattaaactcaaccgggaaactttt

SEQ ID NO: 1536 - DNA, 591 bp, Homo sapien
ctgagttaagatggtaaagccaatattattttaggaggaaagaggacgaaggccaatgaaccaacatctgcctgctatctggtgcatcacccaaggtgaccaatggctgggcacaaataaacttctcttttgctagccacagagttgctcactgtggcaagcctgagctggtcagaacacctgtgtgtgtgttcctgatacacactaaccacaataagcaagtctgcacacatctctatgagccccatgcaaagacaagacattcccaaagatcagtcactagagtgcaacaacgaaattcaagatttgaccaaaacagaccctgctgcctcctaaattgccaattgcctctcaaaaacttacagaaaaagggacattataagaattcatagagggagagaagaaaaagctgctactcctagtcattagtacaatgtgctgtgttaattagatacctctatataaattagaaaaagtgctttacttgcatgcttcaataaaatgaatactgagtgtcgtagtgttagatctgtacagatataaattttttgcagctatataaaagtgtataagatgggcttttgccatttt

SEQ ID NO: 1537 - DNA, 341 bp, Homo sapien
acttcgggcctccctctccctgtgcagaccggttgaataaatgataaaattactgtttgtgtcctctgtgaagtctggattaatggaaaaaaggatttgtgaggctagtcttaggctgtagccaatctggtgtgctttttgtgtcttcctgtatggttccatgataaggaggaataccttaggatagaatgcaagcctaggaccccataagcctgttgttcaagccaaccagcaaactgggcagtaacaaacattgctgcaggtttccattttgttttacgtccttgggagcttgaccttgtaaccacgtggcagtaccttcttttggcctctgccatttt

SEQ ID NO: 1538 - DNA, 363 bp, Homo sapien
ggacctgactttgagtccatcagagacaaagtgagtgagatgcacatacagtgtttccagacctgactcagcccatctgtctgttaggaaactttatgaagacgccccccagaattaaaccctaattcaaatgtctcactctgaatagagaccttctgaaataatcttggtatagagacccagacacgtgccttttgccttaaaataaaaatatttagcccatgttgttttatgtatctgtctttcagttagttttgaaggcccgcacggaaaagtggggcctgtgcacctgaaaagaaatgtgtatgttatgtggttgttggtctttcctactagagttatcttgataattgtgaagagtgg

SEQ ID NO: 1539 - DNA, 371 bp, Homo sapien
ctgtgggggtccttccagagaggagctgagatacgcctacctggaggggcccctgggcctggaggggctcctcagtgtgactgggtgaagtgttttcagaggaccagggttgaggttgggggcatctcatccagaccctgccggcatctgccccagaacccaagggcccctccttcctccctcctcaatggaaatgctggagatgtcctcagtcaccctctgagcactcacacatcaccccttatttggaaatttttctcactctaaccttccttcctgctgcaccttctgccccatccccaggctctggcctctctctctcctcttctaccctttagcaggtaatgactcagttcccactgaggagccag

SEQ ID NO: 1540 - DNA, 403 bp, Homo sapien
ctkgacgtgatggagcaggtgagcagtgcccgtggggcttgccagagggctgaggaggaccctctctaaccagctccctgtcccccttcttctgtagcttgagttgaagaagacactgctggacaggatggttcacctgctgagtcgaggttatgtacttcctgttgtcagttacatccgaaagtgtctggagaagctggacactgacatttcactcattcgctattttgtcactgaggtcagcaatgcaccgttggtttcatgtttcatactgtttacactagcactgccctttttggcttaatttagttcattttgtacctaactgagaactgtgctttctgatgtagtgatgacaatgacagatactcgtttaccaaaaagcaccttctgcctgcagcag

SEQ ID NO: 1541 - DNA, 428 bp, Homo sapien
taaaacaaaactaaagaagagaaaatatattctcgtaaattatctgaacttaaaagatggaagcctggagatagatttgtgataagccattgctgagtacatcctagagttcttgataatttcagttggttaaattacaatagtttgctatttcctccctcacattttatgttctacagtatctagctgcttgggttttcctgtataccatggggcttctgtcatctgggctttactcagtggcatattccctctgcctaaaactctcctcccctctccaccttagaagtagcttttcctagaacggttttcccagggtttcacctaaggtgatagtacaatctacagggacctgcacatgaagacctttgcatacatgccaggaagttggactttatctttggaaaaagggagcctttgaaggtttt

SEQ ID NO: 1542 - DNA, 345 bp, Homo sapien
awttaaatgcttagcaagcagcaattccacgatggtcaaattcctaatatgagagaagtagaaataggaaaaataggtcaccctgatacttatgttttcattttgcttaatatacgtttgtatatttcaatataacattaatagatatcgtgtcccttcacagttctaaagtagtaagcaaaatgaattaatttaacctatgcaattaaaaccaatttggaagaatattgaggtagcacactgttacgggaattagtatgactcagtaatgcagttgaaagttagtggctcctaatccagtatgaatcatggagatgagagaaatgattagataaagagatattt

SEQ ID NO: 1543 - DNA, 420 bp, Homo sapien
aatattgaatttctagaagcagtatattgcttactgcttcttaattacgttatagatgaggtggaaatgataaaaactaaagaagcaagattaatctttaacacacatttcaggctgttgtaaaagaataaacaatgcttcatataaacttctagcaaatgacttcctaatgaggtcttgaaacagtctttagggcacggaatgtcatcacataattaagcagctttaagcctttattaaaaggcttaaagtcgcaaacaatgaaatctgaaacaaactgtaccatattaaactttttgatgatatttcaaattcagtaaaagaaaaaaaggatggttcagaataacatcacgtattctaatcctgaaacacataacaaatgcatctgaaacagcaattcttaaaaaggttttgcccttt

SEQ ID NO: 1544 - DNA, 306 bp, Homo sapien
ctggcttcactcctactccctctctgctcgcagcacgtcggccgccagctctttgatgtgttcccaggcccgctgcacatgggcagattccaccgtgcgagaacagatggcaaagcgcaggacaaacttgtccctgaggtgacatggaaccaagtggatttttttggcactgtttattctttgcagaagagcttcattcactttgttggaaccctttagccgaaagcagacaagccccagaatgacttccacacagatttcaaagcggggatcctggcgcaccagtgactcaaactcatgggacag

SEQ ID NO: 1545 - DNA, 110 bp, Homo sapien
ctgctccgggccttcatcctgaagatcagcgtgtgcgatgccgtcctggaccacaaccccccaggctgtaccttcacagtcctggtgcacacgagagaagccgccactcg

SEQ ID NO: 1546 - DNA, 239 bp, Homo sapien
aaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaagg

SEQ ID NO: 1547 - DNA, 527 bp, Homo sapien
aaaaattccagttgagatttttctggttctctgtataaagattgactggaacatatacattttggggtttatgtttggagactttggctcttattcaaaccttccattttagttggcttcttctgacagtgcttcagcatggaagcaaggagggggcctcattactgccaggtaagggtaaaaatctagtttctctgctgggtctccattgtcactaagaaaggaatggctctgttattgctgggcagggttggctgttccaactgataatcctatgtctgggagggctaggagtgcctccttgctgttcctcttgttgtttccactgacagtggagtggccttgttactgctgggtggtggttgagagttctggctctctactagggaggacacaacctcagtgtagagaggcggggataccttgttactgtcaggcacaggcggaggtccagtctccttactccacctacccaacagggtagcttgaggcacttcattattgcctagtgagagtggaagtttagg

SEQ ID NO: 1548 - DNA, 333 bp, Homo sapien
ctgtgggcggagctagtaggggcggggctacgtgattgacacttctctcctcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcag

SEQ ID NO: 1549 - DNA, 438 bp, Homo sapien
ttgacagtgtacgctggagcaggttccagggtggggctgccctgccgcctgcctgctggtgtggggacccggtctttcctcactgccaagtggactcctcctgggggaggccctgacctcctggtgactggagacaatggcgactttacccttcgactagaggatgtgagccaggcccaggctgggacctacacctgccatatccatctgcaggaacagcagctcaatgccactgtcacattggcaatcatcacagtgactcccaaatcctttgggtcacctggatccctggggaagctgctttgtgaggtgactccagtatctggacaagaacgctttgtgtggagctctctggacaccccatcccagaggagtttctcaggaccttggctggaggcacaggaggcccagctcctttcccagccttggcaatgccag

SEQ ID NO: 1550 - DNA, 204 bp, Homo sapien
aaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagttt

SEQ ID NO: 1551 - DNA, 132 bp, Homo sapien
ccatctgtggatttgtctgtgcacctattggctcttctagctgactcttctggttgggcttagagtctgcctgtttctgctagctccgtgtttagtccacttgggtcatcagctctgccaagctgagcctgg

SEQ ID NO: 1552 - DNA, 433 bp, Homo sapien
ctgaatagaggtcaacacagttgcgatgttgagggatggtctccaagcaccttttggtggcaatttgagaacatccagacaaatccttccagcagaatcaatgtttggatgataaattggagtgagaaatcggatctgaggaggttcaaatgggtacctctcaggaatgataacttctagcttaaaaacacctttctcataaggtgtgttggctccacctaatatttgagctcgcaggtcatccatttggtctttatcttgccaacatgtgatgcctgggggtggctctgtggctaacatgtgcagctctctcttcagacgtgaagctctctgcatgatccccaagtagaaggaaccacacacagttcactgctccacactaagagctgsctgggatgcactgagctgacacccctcacaacgcagcaacgcg

SEQ ID NO: 1553 - DNA, 316 bp, Homo sapien
gagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaagg

SEQ ID NO: 1554 - DNA, 542 bp, Homo sapien
  misc_feature (1)...(542): n = A,T,C or G
aaaggaattattctggcagcacatgtagtattcttggatgatcttgctgctcttatttctccttttgtgtgtgtgtgtgtgtgtgtggctatgggttttcatttgtaactccatctgcttargagagtgggctctctataagggaacctgctgtaaacttcattgcagcaaggatgtagagagaaataggacttaattccactaggggctctcatctcacaccttaaggaggagatttctagaaaaactgggccagattttctttgytctccatcattttaatgtggcaggctgytcagttttcttactcttacctatgwgatatttcttcgtaacgtgtccaaaaagaaaaaagacccaatcagtgtctcttgactttgttctttgatccctcagtttcttcttgatttcagcatgtgtccgggttcctaattttgggtatgagttagcaaatttaaccattgtgtttgtgccctacccaggggactccccagtttctgacttgaagtagactganaagaatccacgaggngctattttgg

SEQ ID NO: 1555 - DNA, 117 bp, Homo sapien
ctgtctgtggcttcccatgtctttctccaaagttatccagagggttgtgattttgtctgcttagtatctcatcaacaaagaaatattatttgctaattaaaaagttaatcttcatgg

SEQ ID NO: 1556 - DNA, 111 bp, Homo sapien
ctgctgcagccgcagtttctcatccggagtgtaccccgtcatgtcgccgctggtaccaacgcaaaaggacacggcgcaccctcgaactacggactagttacttaagcgcgc

SEQ ID NO: 1557 - DNA, 454 bp, Homo sapien
cgaggactgatcctctagtactaagtgactggggatattacaytarccaacattggttgatacatacctkartmatcatwtgaggaygcagtgataarsgsatawwmywgtatsatccyaacaygyactarctcaaaaactagtgggggcggattgatctcctgtgggacwkcacatgscctgaaagtgaacatgmtcmtratcacctgcagrgcttgagatggyccmcatkgcwgcactccgccccyacaktttttgawtcwacwggagttaggswgmtyctwgawttakcctttctacctgcctccygakagrwgcwcwygastwggakgaatssattgackkctaagrttakacttccactaactctgtacgmtgarctcttactaatattcgttaccacgctaagaggctctgctccaggatctcatcgcgactggaaggaacctccagc

SEQ ID NO: 1558 - DNA, 404 bp, Homo sapien
aaagaagtgcagttgatatctaatttacacagtgaaactagtgatagaaaataactaatgaaaaaaaatcagagactggtttccaattgattgacacctagatctgtcagcctctcttaaagaaaggggaaggagaaaaaaaatctcatcatggaaggcagacaagagtccacctgacagaggtggaatctgatggaatctgaccccatttcatgataaacgagaggaaacataaatgccatctcaaatactaaagcgatgtagtgtagcatgagtgactcaatgcaaattcacagaggaaaagaagttacggcttaggaagtaggacaataaatacaaatatttcatcttatttaatggtgcatgacttcagtgaaactaccctttgcaatgcaataaatttt

SEQ ID NO: 1559 - DNA, 266 bp, Homo sapien
aaactatcagaagagatgagagggaattgatctacaatactagaattttatgtgcagacaaatccacatctggaaatgaaatcacagtaagatattttcgggagaccaaaacataaaaattgctagaataaatttgccacgaacgagtaactagacattagaaattgactacatagatatagtaatactaaaagtgctgaaaacaagcaaacacaacacacacattctcaattctttttttttctatcaaatatcttcaacttttt

SEQ ID NO: 1560 - DNA, 142 bp, Homo sapien
aaaactcagtatcttctgaaccagaggcatttctgattagcccttccctacctattttcctagtatcactctttaatcagcttggggaggtggcagcatttcatggcctccgtagtaactcacaatgcttcctggggtattt

SEQ ID NO: 1561 - DNA, 381 bp, Homo sapien
aaacactaaatgaagcttctcacaatttctaattataaacaaaaggctgaaaacagtatgggaaacaaagtttcaaaacaaagaaaagttgagtaaaaggtgccccctctatggctcatctgaaagaaacattttactcagagaggcaaacatttctgatctaggagtaagtttcccactcactttgcaaggacccactcattctgcagaaagacctacaagtctttctggtctcaattgcaaagtacgtgaaaatgtgtatgaaagatctaaaagctaaatattagaataaggctaattgaaatcaaaattgtgtgctggtctaaatatacatcttcggcttcttcctttttagtaagtatttttatttcagatgtattt

SEQ ID NO: 1562 - DNA, 368 bp, Homo sapien
ggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcag

SEQ ID NO: 1563 - DNA, 411 bp, Homo sapien
  misc_feature (1)...(411): n = A,T,C or G
accwtrsaactgcawttattacctatgctagntttggataagaamtgkycwtayatgtgakagcaagagggcacyarawswrcttsaacaccaawgggcmktactwtatakawmcgawgggcatgctwtmatgaccaactgrmtgactgtttgagaatggacaargtgctagcgctaaacctgtccttcttgaacrtggcttgactaacgkcwttgatacgttrccttcakkasaatactattactasactttgktgcttgattaccgactggtgcactcttgmtctcacctatgargacagtgctttacacaaactcrtakggaaaattgnntttgtmctgtganctactcatcygaganctccctaagggctaacattncatgtttccgtctcactagctacacgttct

SEQ ID NO: 1564 - DNA, 602 bp, Homo sapiens
  misc_feature (1)...(602): n = A,T,C or G
ctagttttaagatcagagttcactttctttggactctgcctatattttcttacctgaacttttgcaagttttcaggtaaacctcagctcaggactgctatttagctcctcttaagaagattaaaagagaaaaaaaaaggcccttttaaaaatagtatacacttattttaagtgaaaagcagagaattttatttatagctaattttagctatctgtaaccaagatggatgcaaagaggctagtgcctcagagagaactgtacggggtttgtgactggaaaaagttacgttcccattctaattaatgccctttcttatttaaaaacaaaaccaaatgatatctaagtagttctcagcaataataataatgacgataatacttcttttccacatctcattgtcactgacatttaatggtactgtatattacttaatttattgaagattattatttatgtcttattaggacactatggttataaactgtgtttaagcctacaatcattgatttttttttgttatgtcacaatcagtatattttctttggggttacctctctgaatattatgtaaacaatccaaagaaatgattgtattaannattt

SEQ ID NO: 1565 - DNA, 473 bp, Homo sapiens
  misc_feature (1)...(473): n = A,T,C or G
ctagtccagtgtggtggaattcatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgttnagagataaggtgatgtcagagtttaataacaacttccggcagcagatggagaattacccgaaaaacaaccacactgnttcnatcctggacaggatgcaggcagattttaagtgctgtggggctgctaactncacagattgggagaaaatcccttccatgtngaagaaccgagtccccgactcctgctgcattaatgttactgtgggctgtgggattaatttcaacganaaggcgatccataaggagggctgtgtggaga

SEQ ID NO: 1566 - DNA, 53 bp, Homo sapiens
  misc_feature (1)...(53): n = A,T,C or G
ctagttattaatagnaatcaattncggngtcattagttcatagcccatatatg

SEQ ID NO: 1567 - DNA, 136 bp, Homo sapiens
  misc_feature (1)...(136): n = A,T,C or G
ttattgatttttttttttcactttccccatcacactcacacgcacgctcacactttttatttgccataatgaaccgtccagcccctgtggngatctcctatganaacatgcgttttntgataactnacaaccctac

SEQ ID NO: 1568 - DNA, 192 bp, Homo sapiens
  misc_feature (1)...(192): n = A,T,C or G
ttgngtctgtgtgagnnggttgaccttcctccatcccctggtccttcncttnccttnccgaggcacagagagacagggcagnatccacgtncccattntggaggcaganaaaagagaaagtgntttatatacggtacttatttaatatccntttntaattanaaantnaaacagttaatttaattaaagagt

SEQ ID NO: 1569 - DNA, 575 bp, Homo sapiens
  misc_feature (1)...(575): n = A,T,C or G
ctagttctgtccccccaggagacctggttgtgtctgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggngacagtcactagcttatcttgaacagatatttaattttgctaacactcagctctgccctccccgatcccctggctccccagcacacattcctttgaaataaggtttcaatatacatctacatactatatatatatttggcaacttgnatttgngngtatatatatatatatatgtttatgtatatatgngattctgataaaatagacattgctattc

SEQ ID NO: 1570 - DNA, 392 bp, Homo sapiens
  misc_feature (1)...(392): n = A,T,C or G
ctagtccagngtggtggaattccgccgccatcatgggtcgcatgcatgctcccgggaagggcctgtcccagtcggctttaccctatcgacgcagcgtccccacttggttgaagntgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgnctgattctaatagagagc

SEQ ID NO: 1571 - DNA, 390 bp, Homo sapiens
gaaggacgtttgtgttggaagccctggtatccccggcactcctggatcccacggcctgccaggcagggacgggagagatggtgtcaaaggagaccctggccctccgggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattca

SEQ ID NO: 1572 - DNA, 383 bp, Homo sapiens
  misc_feature (1)...(383): n = A,T,C or G
ctgcagcttctgctgctgaggccgggattgctacgactgggactgaaggtgaaagaggtggaatccgaagtcctgggactgcgggatgctaaacattgaaagctgggtgtaggcactgcagggagagtgtggaggtctgacagggtaggaatatgtgggagggctgggctaggaatggccttggaggctggcctgtgtggatatggcaccaattctaccctgctcctcttttccttttcccagactcagacgatgccctgctgaagatgaccatcagccagcaagagtttggccgcactgggcttcctgacctaagcagtatgactgaggaagagcagattgcttatgccatgcagatgtccctgcangggagcagagtttgg

SEQ ID NO: 1573 - DNA, 149 bp, Homo sapiens
cctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttgg

SEQ ID NO: 1574 - DNA, 143 bp, Homo sapiens
ctgccaggctgaaaagaagcctcagctcccacaccgccctcctcaccgcccttcctcgggagtcacttccactggtggaccacgggcccccagccctgtgtcggccttgtctgtctcagctcaaccacagtctgacaccagag

SEQ ID NO: 1575 - DNA, 112 bp, Homo sapiens
ctgcatccaccctctttcagggggtagagccactatacttctcatgtagatcagccacattgtcactggagactcggatccagccatcctcccgcacgtggtagaggttgac

SEQ ID NO: 1576 - DNA, 198 bp, Homo sapiens
ccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaggcccttctgtctgtcagg

SEQ ID NO: 1577 - DNA, 444 bp, Homo sapiens
cctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgtcatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccagg

SEQ ID NO: 1578 - DNA, 294 bp, Homo sapiens; identical to SEQ ID NO: 1031

SEQ ID NO: 1579 - DNA, 295 bp, Homo sapiens
  misc_feature (1)...(295): n = A,T,C or G
ccacaaagccattgtatgtagctttagctcagcgcaaagaagagcgccaggctcacctcactaaccagtatatgcagagaatggcaagtgtacgagctgtgcccaaccctgtaatcaacccctaccagccagcacctccttcaggttacttcatggcagctatcccacagactcanaaccnngctgcatactatcctcctagccaaattgctcaactaagaccaagtccccgctggactgctcagggngccagacctcatccattccaaaaatatgcccggtgctatccgcccag

SEQ ID NO: 1580 - DNA, 166 bp, Homo sapiens
cttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcac

SEQ ID NO: 1581 - DNA, 449 bp, Homo sapiens
  misc_feature (1)...(449): n = A,T,C or G
ctgaggcaacagaataaatgcagaggcattacaatgaatcccacttaatataaagaactatacagaccaacacttctctacaaaatttttttttcctcattgccagttaaatacagagttttactttcatagcttaacaatgaagggtcatacactgaagccaatacatatacctagcatttcagtctaagcttgtccacgtacatagctgaagtcaattacaaggtttggcctagaaatgctaggggaacttctttgtagtttttacaggtattaaacttcatcttgcacactgaagtcatcatacatacagggcaaaatcagagcttttatatttgcgtttattcttcatttaactttttataacactactatagtttattaaaacaaaaaacaaagagcaagtagtgagcatattangattacagtcctttcactcattcacacct

SEQ ID NO: 1582 - DNA, 302 bp, Homo sapiens
ccaatgggctttgctgtagcttgctgaaatcaccaagcaggagagatttaaccagaggcgatgtgtccagtcaccagcatagagccatcctctgtgtcaccatccacacgcagggccttctggcagacctcatgcaatgccctccatgttaatattcatcagaaaatggataattaggggggccagcaaaaatatcaagggtcaaatatcgcacatttctgtttaggccatctatggctttcatctcctctgaagtcaactggaattcaaacacctgcacgttctgtctgatgcgctgctca

SEQ ID NO: 1583 - DNA, 170 bp, Homo sapiens
ttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggagg

SEQ ID NO: 1584 - DNA, 368 bp, Homo sapiens
ccagacgtggtggctcacacctgcagtcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccagg

SEQ ID NO: 1585 - DNA, 392 bp, Homo sapiens
caaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttctaagagtactgtgtcttcctgtcctgcatcgccatgatgtgtaacgaattctttgaaggcttcccagataagcagcccaggaagaaatgaaaactcctctgatgtggttggggggtctgccag

SEQ ID NO: 1586 - DNA, 158 bp, Homo sapiens
cctccactgccagcctatggttgttcgccaccaagccaggagtgctgcaccgcccagtggtccccctcgggctccaggcccccactgagaccctctcggaggcagaagcacttcacccctcagagtcctacaagtccaaccagtggacctggaattgg

SEQ ID NO: 1587 - DNA, 85 bp, Homo sapiens
ccaatgtacatggtggactatgccggcctgaacgtgcagctcccgggacctcttaattactagacctcagtactgaatcaggacc

SEQ ID NO: 1588 - DNA, 369 bp, Homo sapiens
  misc_feature (1)...(369): n = A,T,C or G
ccaggctaccttcccactggagacaggcagggggacaggtgctaagggacctggcaggcagggctggcaggccccatggcgcctgttccagcagatgacaagcccaggtcagggtagagcgggcaggaggggggacgagggctcccacaacatgattttgtgtaaaatatggcagcgacacacgctcagggccgggaggtgggggttagggtggggacggcggcaacatcgtgtaaaaaagtgtcccagttcccatagcaaagagagctgtgaccgggtgttcagagcttctccagtacaagggggaaagccgcccggcgggggcggcgggcagggacatcatttggtttcctggtgctgtcngtccga

SEQ ID NO: 1589 - DNA, 361 bp, Homo sapiens
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacccaggacggtcagcttggtccctccgccgaacagtacaaagggactcaggctgttatcataggactggcagtaataatcagcctcatcttcagcctggagcccag

SEQ ID NO: 1590 - DNA, 434 bp, Homo sapiens
  misc_feature (1)...(434): n = A,T,C or G
ctggagaaggtgtgcaggggaaaccctgctgatgtcaccgaggccaggttgtctttctactcgggacactcttcctttgggatgtactgcatggtgttcttggtgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgacnacaaccactatggatacccgcactcctcctcctgagg

SEQ ID NO: 1591 - DNA, 439 bp, Homo sapiens
  misc_feature (1)...(439): n = A,T,C or G
gctttcgccagaaaatgttgcatgtcaaacaatatgtgatccatactgtgtgtcgtccttgggggtttatttgactttgtcacaatgacagccaacagtgagactgataagcctgtaaaaataaaaaaataagactaatcaaatagacatggcattttaatctcaaagtgcaaaatcatctaactgaaaatgacggcattgagaaattccagtggttaaaaatgaatcaaaacttcattacgcaggcagtggaagtgtgttgaaagatttaccaggggtgtcaagttttagacactcagaaaggcaccattctagccatcttgattggataacatgtatatacttatgtccctacgatattcaaaagataatactgttttagtacaaaacaatcaaacaaggcaaagantcaaaaccaagccaacccaaatatccccag

SEQ ID NO: 1592 - DNA, 74 bp, Homo sapiens
  misc_feature (1)...(74): n = A,T,C or G
tttttttttctaatgttcacagtccctgctttatttccatttgttcacacacnctttaaaaaaaaaaaaaaaaa

SEQ ID NO: 1593 - DNA, 288 bp, Homo sapiens
ccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggccgtggagaagtgtaaagatgcaggattgg

SEQ ID NO: 1594 - DNA, 455 bp, Homo sapiens
ccacacagactcaccaagccacagacttgtcttccacaagcacgttcttaccttagccacgaagtgaccaagccacacgtactaaaggttgaactcaaagatatgtacagggtattaaacaaataccaaggggaacagttaacttcaatacaaggtcaaaatcagcaacaagttctacaatccagtgctgatatcagatacaagcttcaaggacaatttcttttcgaaggcttattccagtttcgtgaggctagcatgaggtgtgtgcatttgccaggggcaaatttctattctcaattaacccatgcagcaaatgctacgcatctgctgagtccgtttagaagcatttgcggtggacgatggaggggcccgactcgtcgtactcctgcttgctaatccacatctgctggaaggtggacagtgaggccaggatggagccaccgatccacaccgag

SEQ ID NO: 1595 - DNA, 367 bp, Homo sapiens
  misc_feature (1)...(367): n = A,T,C or G
ccaggctaccttcccactggagacaggcagggggacaggtgctaagggacctggcaggcagggctggcaggccccatggcgcctgttccagcagatgacaagcccaggtcagggtagagcgggcaggaggggggacgagggctcccacaacatgattttgtgtaaaatatggcagcgacacacgctcagggccgggaggtgggggttagggtggggacggcggcaacatcgtgtaaaaaagtgtcccagttcccatagcaaagagagctgtgaccgggtgttcgagcttctccagtacaagggggaaagccgcccggcgggggcggcgggcagggacatcatttggtttcctggtgctgncagtccg

SEQ ID NO: 1596 - DNA, 193 bp, Homo sapiens
ctgttcttcatgcgcctggtggggaagacgcccattgagacactgatcagagacatgctgctgtcggggagtaccttcaactggccctacggctcgggccagtgaccatgacggggccacgtgtgctgtggccaggcctgcagacagacctcaagggacagggaatgctgaggccccgggaggcccctcgagg

SEQ ID NO: 1597 - DNA, 145 bp, Homo sapiens
ccatgctggatgttctgctgcttagacctgatctgctgccaattaccaggggcaggtcaaggatgaccttcttggatccaggaacgctaacatagatcagtaaggaatattcaactcgaaggatgttgcagcccaggatagaagg

SEQ ID NO: 1598 - DNA, 445 bp, Homo sapiens
ctgcctataaaactagacttctgacgctgggctccagcttcattctcacaggtcatcatcctcatccgggagagcagttgtctgagcaacctctaagtcgtgctcatactgtgctgccaaagctgggtccatgacaacttctggtggggcgagagcaggcatggcaacaaatcccaagttagggtctccaatgagcttcctagcaagccagaggaagggcttttcaaagttgtagttacttttggcagaaatgtcgtagtactgaagattcttctttcggtggaagacaatggatttcgccttcactttcctgtccttaatatccactttgttgccacacaacacaatggggatgttttcacacactcgtaccagatctctatgccagttaggcacattcttgtaagtaactctcgatgttacatcaaacattatgatggcacac

SEQ ID NO: 1599 - DNA, 142 bp, Homo sapiens
cctgccccagggggaagcacggacccgagacgacggcgatgaggaagggctcctgacacacagcgaggaagagctggaacacagccaggacacagacgcggatgatggggccttgcagtaagcagcctgacaggagcaatgg

SEQ ID NO: 1600 - DNA, 297 bp, Homo sapiens; identical to SEQ ID NO: 389

SEQ ID NO: 1601 - DNA, 289 bp, Homo sapiens
ctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgcctcggcaaaaaagcacaagcgaaccccagccctgattgccctgcgctaccagctacagcgtggggttgtggtcctgg

SEQ ID NO: 1602 - DNA, 398 bp, Homo sapiens
  misc_feature (1)...(398): n = A,T,C or G
gggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgagaaggaaggactcaagtacaagtccaaagtttcactgaaaggcaatagagaaagtgatggatttagagaagaaaaaaattatnaacttaaagagactggatatgtagtggaaaggcctagnactacaaaagataagcncanagaagaagacaaaaattctgaaagaataacagtaangaaagaaactcagtcacctgagcaggtaaa

SEQ ID NO: 1603 - DNA, 438 bp, Homo sapiens
ctggtgatctgctttcttaccctaactcttgacaaatgagtcgtctactattttaaagagtctggaggtctctgactctgccataacaataacctgctgttaatttataacacagatttttgtttggaagagccttatttgaaatacactttgattcattttcttaaatatttatattcttttcttgcttacttcagggttggtagcttagttggaagtgccagcacctggcacctattcatatagaacaggctgtactcaagacaacttctagcatttactttaagacttatataatttatttctattttgtgtgtactatagtcttgtgcatatgtagttgaacacacagtgaaatatatgtctctctttgtggatgtgcggcctaaaaatttgaatgtctggtgagagagagccatgtgtataggtcagagaaaa

SEQ ID NO: 1604 - DNA, 297 bp, Homo sapiens; identical to SEQ ID NO: 389

SEQ ID NO: 1605 - DNA, 451 bp, Homo sapiens
ggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaag

SEQ ID NO: 1606 - DNA, 272 bp, Homo sapiens; identical to SEQ ID NO: 1006

SEQ ID NO: 1607 - DNA, 444 bp, Homo sapiens
ccaggctggtctcaaactcctcacctcaactgatccgcccaccttggcctcccaaagtgctgggattataggtgtgagccaccgtgcccaaagttaagtatttttgatcaagtgttttgtcttttgtgcaaggcatttgtggctctgtcatagcagaggaaaacaaaacatgcctatcaaatgaatcaagtccgacctcttctcatattgagcaactagaggtctaggaacatttcccctacctgtcattctcatctggcataccaggtgtacatactccttcttattctcctctgttaccaagatgttggccccattgggtttgaggtcacgaacttcacaaactccaaactcttggacctcagtgctgaaggtgaggtcatagcctagtgtggagacatcattttccagcagataaaccagaccttggtagaagtggtaatc

SEQ ID NO: 1608 - DNA, 189 bp, Homo sapiens
caaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcgcacccctgtcccacccacacag

SEQ ID NO: 1609 - DNA, 426 bp, Homo sapiens
cttttgttatccttagaggactcactggtttcttttcataagcaaaaagtacctcttcttaaagtgcactttgcagacgtttcactccttttccaataagcttgagttaggagcttttaccttgtagcagagcagtattaacacctagttggttcacctggaaaacagagaggctgaccgtggggctcaccatgcggatgcgggtcacacggaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggcca

SEQ ID NO: 1610 - DNA, 447 bp, Homo sapiens
cagggctatagtgcgctatgttgatctggtgttcatgctaagttccgcatcaatatggtgacttcttgggagtgggggaccaccaggttgcctaaggaggggtgaacctgcctacgttggaaatagagctggtcaaaactcctgtgctcatcagtagtagaattgcacctgtgaatagccaccgccctccagcatgggcaacatagcaagaccctgcctcttaagataaaaattggaaaacactggtaggaaaaaaaggctgtttggtctaaataagtctggattgggtataaatgacacaaaactatcatgaatttgaaagcatttctaatttcttgaaagtctgaaaaagtttaaacagaattttagctgaaaagtcctgaaagacatttgaaaaaaaacagcaagaacacttaaaactattcaaggtttgggctgggcacagtg

SEQ ID NO: 1611 - DNA, 238 bp, Homo sapiens
ccaccggggttgacctctctcgctagcagggcccacccagctcactccccgcgtcttccatcccctctaggattcccattgtcccctactccagcactaggcaggcacccccagcccactgcgactcccaccacgaaggaccccagccctctctcagccaacacggccccgcccaccgtctcagacatcgtgcttcttctggtgggccaggagtctctcctcgtcgtcgaaggtctgg

SEQ ID NO: 1612 - DNA, 293 bp, Homo sapiens
ctgctgcttgtatcctcgggagagggtttcccactctgagcgggtgggaaggcaatgccaaacatccgggaaaaataaaaccactgtctccacatgagctggaactgtacgccccttgtgggtctcctcagggcgatggtagcgaatctctgcaaaacggtaccattgtgtgcacacacttagatcaatgcctgtcagagccttacaacaacgaatagcagtcttaatcaacacagagggatctttttctgggtctggtccatccaacgaaggagaccagtggcccccaatgg

SEQ ID NO: 1613 - DNA, 224 bp, Homo sapiens
ctggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgactctgccgatgtgg

SEQ ID NO: 1614 - DNA, 439 bp, Homo sapiens
ctccaccctggcgatggctccctggtcctactttctctctcaaactggctttttctcattcctttgactccgccagacttcctcgcccccatgacctggtgttgtgtctgatcaccccaacattcctggctgcccaatgtggggcaatgaagaccccagtgaaggaatgctagagtgtgtgaaagtggaggacgcatcgtcaaaggacacctgaggacgtctcaaagaagctcggcgggagagctgagcgctcggaagaaccaagaatcatctcttttgaaaaatcgattcatcaaatgaatcttcggccaacaactgttcaagaaggattcaaatatcacaggttccaagaagtaaagctttggaggtcacaaaattagcaatagaagctgggttccgccatatagattctgctcatttatacaaataatgaggagca

SEQ ID NO: 1615 - DNA, 237 bp, Homo sapiens
aggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtagg

SEQ ID NO: 1616 - DNA, 266 bp, Homo sapiens
ctgggctctagtttcattccatctgtcattctcaggtaacagggacacatgtccaagtgttggcccccgtggcatgattgtagctttgttgataggcattgcatcttttgtgtaatatgcaataatggcatgaccagattcatgatatgctgtgatggttttgtttttgttatcaatttccacacttcttctttcaggccccattagaattttgtctttggaaaactccagctccttcatggtaaccatttcttttccatcaacag

SEQ ID NO: 1617 - DNA, 185 bp, Homo sapiens
  misc_feature (1)...(185): n = A,T,C or G
ccatggctaggtttatagatagttgggtggttggtgtaaatgagtgaggcaggagtccgagnaggttagttgtggcaataaaaatgattaaggatactagtataagagatcaggttcgtcctttagtgttgtgtatggttatcatttgttttgaggttagtttgattagtcattgttgggtggtg

SEQ ID NO: 1618 - DNA, 354 bp, Homo sapiens
  misc_feature (1)...(354): n = A,T,C or G
ctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatggngatagtacacatntcactcagagngcatntntgcatcttntaanatanatttcttaaaagcctctaaagtgatcagntgccttgatgccaactaaggaaatttgtttagcattgaatctctgaaggctctatgaaaggaatagcatgatgtgc

SEQ ID NO: 1619 - DNA, 170 bp, Homo sapiens
  misc_feature (1)...(170): n = A,T,C or G
ctgtgctgtggagagaagctgatgttttggtgtattgtcagccatcgtcctgggactcggagactatggcctcgcctccccaccctcctcttggaattacaagccctggggtttgaagctgactttatagctgcaagtgtatctnncttttatctggtgcctcctcaaac

SEQ ID NO: 1620 - DNA, 386 bp, Homo sapiens
cctgttgattgcatactgtagaagatttgatgttcagactggttcttcttacatatactatgtttcgtctacagttggtaaatttttgtttttctttgtattaaatgttgaattgtattgtctggaggaaaagacagaggtctaaaaataaagaaggagtacagtttgggcatggtggttcacccctggagtcctagcactttgggggccaaggcaggcagattgcttgagcccaggagttctagatgagcctgggcaacatagtgagaccccatctctaaaaaaacagttttagggccaggcacagtggctcacacctgtaagcccagcactttgggaggccgaggcaggcagatcataagggcaagagattgagaccatcctgg

SEQ ID NO: 1621 - DNA, 346 bp, Homo sapiens
  misc_feature (1)...(346): n = A,T,C or G
ccaattctgcccgttccccgtgggccaacaacactggggttgtatgcgtctggaaccctgtgatagtcttcggcttgccagcctggcccaccacatccactgcctggcccacacggacagacactggcaatggccgcagctcctcatcaaacgtaaccagcattcggggctgcatggcagccaccagcccatacaatacatagtgtgatttgcctagaataatgtttcgaacatccaggaaagagacaagcacagtgagcagtccanccacggccacctggctcataagctgccggtcgctgtggtaggggcagagggtaagggtgcccttccctaaatgtgtcag

SEQ ID NO: 1622 - DNA, 366 bp, Homo sapiens
ggaagtttgtgctctctgcgtggctaagtttttcacctactaggacgggggtggggtggggagaacaggtgtccttctaaaatacagcacaagctacagcctgcgtccagccataacccaggagtaacatcagaaacaggtgagaatgaccactttaactcaccgggcccgtcgcactgaaataagcaagaactctgaaaagaagatggaaagtgaggaagacagtaattgggagaaaagtccagacaatgaagattctggagactctaaggatatccgccttactcttatggaagaagtattgcttctgggactaaaagataaagaggggtacacatctttctggaatgactgcatatcatcagg

SEQ ID NO: 1623 - DNA, 165 bp, Homo sapiens
ctgttgattggctgtgacactgctttgtgtcatcttcttaccatgatcaaaggcgaaggaagggatctcttttgggacattgtgattgttttagcagagagagaaagagatgaaatacacttcggttttctcttaaaagatgcatgtatcatacagtgctttaag

SEQ ID NO: 1624 - DNA, 227 bp, Homo sapiens
ccaatgcccggagcaggccctctttccatcccctgtcggatgagctggtcaactatgtcaacaaacggaataccacgtggcaagccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatgg

SEQ ID NO: 1625 - DNA, 373 bp, Homo sapiens
ctgtagcttttgtgggacttccactgctcaggcgtcaggctcaggtagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggtgggaacagagtgaccgagggggcagccttgggctgacctaggacggtcagtttggtccctccgccgaacacccgaagataattagtgctgtctgttgagtaacaatagtagtcaccttcatcttccacctgggccccagtgatggtcaaggtgg

SEQ ID NO: 1626 - DNA, 367 bp, Homo sapiens
ccagacgtggtggctcacacctgcaatcccagcaccttaggaggccgaggcaggaggatccttgaggtcaggagttcgagaccagcctcgccaacatggtgaaaccccatttctactaaaaatacaaaaattagccaagtgtggtggcatatgcctgtaatcccaactactcagaaggccgaggcaggagaattacttgaacgcaggagaatcactgcagccctggaggcagaggttgcagtgagccgagattgcaccactgtactccagcctgggtgacagagcaagactccatctcagtaaataaataaataaataaaaagcgctgcagtagctgtggcctcaccctgaagtcagcgggcccagg

SEQ ID NO: 1627 - DNA, 424 bp, Homo sapiens
ctggataaggacatcaataccttctctatgcgtgtcagggtgtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctgg

SEQ ID NO: 1628 - DNA, 314 bp, Homo sapiens
tcgactgttatagcttagaaagcaacactactactatgagactataaaacattaaactattttaagaaaaccacgctgtggaaaaatggagccatttttgtcaaaaagtggctcaaagcacaaaactgctcagatgttcaagagtcctaggagtctgggctgcacagtattaaggggtgagaggagaccgacagcctgtttgaatcaggcttgtgagcccagctcatctgacaacttcaaagagcttctctgcctatacattccaccgtttagcataagacaccactttacgctatttacaagtctccttttgg

SEQ ID NO: 1629 - DNA, 393 bp, Homo sapiens
  misc_feature (1)...(393): n = A,T,C or G
ctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgttttcccccaatgtttaaaatgtttggatggtntgttgttctgcctggagacaaaggtgctaacatagatttaagttgaataacattaacggtgctaaaaaatgaaaaattctaacccaagacatgacattcttagctgtaa

SEQ ID NO: 1630 - DNA, 317 bp, Homo sapiens
ctgcaagaatatcagaaatcaatacaaacaagtattgacaggtgttacagacatgcaaaatatccttcaatgcaacgaatttttaagaaatcagctagcctatattaatcagatgttttaggtcaaaccaagtttccatctcgggctcagtgaaatagtattaactcattgagtctcctttcccccaggaatgttgggaatggcagaacagaaagagctatcactccttaaattcttttatgcgagtgttactccaacacttattttacttggtttacttggaatgtatgagaggaaactgatgttttttacaatgg

SEQ ID NO: 1631 - DNA, 262 bp, Homo sapiens
ccttaggcaagtcaccttacttatctaagactgtttccccacctggaagatgccctacaagcctcctgtggctgtgtttagaaagcatgcccggcctttcttgacagccagccaccccagatgatggcagggcaaggaagactgttaggagtcagagtgctcccctcaggtggaaggaaactgggccaactctactttgtaagccatagggtgccaggtagcccggccaccctgagcctgtgcctccactgcccccgcgtgg

SEQ ID NO: 1632 - DNA, 138 bp, Homo sapiens
ctggaattaattcttcgacaactccagaccgaccttcggaaggaaaaacaagacaaggccgttctccaagcagaagtgcagcacctgagacaggacaacatgagactgcaggaggagtcccagaccgcgacagctcag

SEQ ID NO: 1633 - DNA, 192 bp, Homo sapiens
  misc_feature (1)...(192): n = A,T,C or G
ccttgaagggacctcanagcaaaggaagagacctgggtgtggtgaggcatcccanggcatggaagggaccggttgtgctnngggaatccactgnnccctccttggnnaaaaaagcacaacacatcatacatatttaccagaccagaagcgctggccccaagtctccccaacctggtcgggggaacctcctgg

SEQ ID NO: 1634 - DNA, 447 bp, Homo sapiens
ctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatg

SEQ ID NO: 1635 - DNA, 364 bp, Homo sapiens
gttttatttgagacataaaaacacatgtgtttctattacatagtgtggggtttagggtcctggtttctaagacaagactttatttcaccctgtatcacagcttcctgggaaatgaattagggagcaagagacggcctggcaagaaaatcattattgttgctgggaagttgcaaagaaaggggagagtttattcaaattagtgtaacagagcccccaggatgaagagagtggtgcagggaaaaggtctaaattcctggtgttggtggggacactggcacatcccacagcaaggactcagccctcaacggcggcggctgggtcttgggaggggagtggtgggagggtaagggctcctcagctccct

SEQ ID NO: 1636 - DNA, 399 bp, Homo sapiens
ctggctggctagactgtttgtgcgccaagaggatggtcagcgctgctttccagcctggctctgctggggcgctggcatctggttcagttccaccattctccctgctttctttgccaagtgtgatattcacccaagggcaccagtctctatgctgagaggtgggatcaaagaagcttcgggaagatgtgtccgaactgctggaggagcagaggcgagctcgcttggctttccgcagagggctagatggtacctccaggccaggggtgtctcctgttcccatgcttcgggtcactgggcgagttctggtggtggggctagcagcctctggctcaggacggtcaacaggactggaagagtcccagctccgagttcgagagacaatgggaccagggctctttt

SEQ ID NO: 1637 - DNA, 246 bp, Homo sapiens
ctgagctttcagcagataaatcacagcagaaatagaatcaccctaggactttcaatcaaaagctggaagtccaccttacagaaagacaaaaagaaacccctttttatatcttaacaaagcaatagctctcaagcagcagagcatctcgaggaagaaagcttgcccggtcgccatcccatcatgccagagcgtgcagtgtccacccttgactacgctggggaattgctgattttttgaaaaagcttg

SEQ ID NO: 1638 - DNA, 453 bp, Homo sapiens
ccaagagttctccactgtgaagactgaaaggacctggtgacatttcggcatcagtcctgttaccacttggaggtaacagaagcaggctcgtgtcctcctttaattctaccacactacatgactcgcaattggttctgaaattagaacgttcaccatcgtacttaaaatcttaggggcatgaagagtcagctagaacaaggaaaaagaaagtcgcaggtagtaggtaagtaggtgggcacatgaaaagccaagctgctctgtccaacaccagtgtacatgtgctttaactaaatgaactccagaggccaacagcagcagacctgctcaattcaccttccaaatcagaacaagaccaaaaagctcaggcttgagttgtcaactatgcataggttccgccagtgatgaggagctcgtaagcaggatctctactccttctgcacaacacgatgcaag

SEQ ID NO: 1639 - DNA, 197 bp, Homo sapiens
tttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattgg

SEQ ID NO: 1640 - DNA, 278 bp, Homo sapiens
ccagagcggtgagtcccaccacctcgaactctgggaattcgagccacagctctgccagtaccccaagactcagcactagtctgatgacctgctaattcactgacagcatagggctgtctgttgtttttgcgcaagttggtgtgaacaaagttcacaatatctggtcgaataggagccttgaatacagcaggcaaagtgacatttttgccagatgactcccccttttcggagtacaccgatatcagtgggcgagcgcacgccatggcggacctcggccg

SEQ ID NO: 1641 - DNA, 227 bp, Homo sapiens
ccattgttcccgtgcatcgaagcttgcaggcagcttcaggtcctcggtaaacataactctctggggtggcttgggcccacccaggaaggtaccacatagcctcttcaagtagctcatgtccacgttgtagaagttgtgcccggcttgccacgtggtattccgtttgttgacatagttgaccagctcatccgacaggggatggaaagagggcctgctccgggcattgg

SEQ ID NO: 1642 - DNA, 299 bp, Homo sapiens
ctgcacatcaaggacatcttcaggaagttcaggattgccgtagctaaactgaaaaccaccatccatggactctccaaaccaaacgtgtttcttctcagcactagaatctgtccaccagtgtttccgtggaacattcaaaggattggcacttatgcatgtttccccagtttccatattacagaataccttgatagcatccaatttgcatccttggttagggtcaacccagtattctccactcttgagttcaggatggcagaatttcaggtctctgcagtttctagcggggtttttacgag

SEQ ID NO: 1643 - DNA, 301 bp, Homo sapiens
ccaagggctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagagctttgcctgatgtctaccagaagccctgtgtgtggatggtgacgcagaggacgtctctatgccggtgactggacatatcacctctacttaaatccgtcctgtttagcgacttcagtcaactacag

SEQ ID NO: 1644 - DNA, 365 bp, Homo sapiens
ctggtgagcgaaggatgggagcagagaacagagctaaaacccctggttttcctttccccagatgtaaagcctgctagctggaactcacagaagattggaacaaaaagataggagatggacacctgggggactgctccagcacgaagggaagcgatgagcatcacacagcagggccattgcaggggacaggtgctgtaattcctgcccagagaacttgaaagcttacagtgtgctcacaggaaggaatcggctcagctagtccagaaattgctgcatttcccatattacttagttctttattcatcctgtggtaaagagtcacccttgttttccgtatctataaaactgaaagacttaaaatttac

SEQ ID NO: 1645 - DNA, 249 bp, Homo sapiens
ctggtgctggaactgcagaaagttaagcaggagaacatccagctagcggcagacgcccggtctgctcgtgcctatcgagacgagctggattccctgcgggagaaggcgaaccgcgtggagaggctggagctggagctgacccgctgcaaggagaagctgcacgacgtggacttctacaaggcccgcatggaggagctgagagaagataatatcattttaattgaaaccaaggccatgctggaggaacag

SEQ ID NO: 1646 - DNA, 433 bp, Homo sapiens
  misc_feature (1)...(433): n = A,T,C or G
ctgtggccggattgatggggcccccacttcctagggctgaaggcaagttgaaggaagcagcaggagtaccggaatgaaaaccttgtttctcaaaggactgctgggttttggagtacacagaacccgagatatctggcacgcccgtgttactggaggtgactgaaacaccagtgttgtatccatgagacccatatccactcggctgttggaaaggggtggccgatgcattcacactgacattcacaccatgctgcttggaagaggtaggagccacagggaacacagcaggcccatactggaaggtgctggggaggcccgggacccctgtatagtatggcaggctggtgtaaactgtagccaggaggcagcgccgggttcaggaatgtctgctgcgtggnatggtgagtctgcgtctggtttctgttggggttgg

SEQ ID NO: 1647 - DNA, 451 bp, Homo sapiens
ccagcttgcaagcacgctggcaaatctctgtcaggtcagctccagagaagccattagtcattttagccaggaactccaagtccacatccttggcaactggggacttgcgcaggttagccttgaggatggcaacacgggacttctcatcaggaagtgggatgtagatgagctgatcaagacggccaggtctgaggatggcaggatcaatgatgtcaggccggttggtagcgccaatgatgaacacatttttttttgtggacatgccatccatttctgtcaggatctggttgatgactcggtcagcagccccaccaccatctccaatgttacctccacgagccttggcaatcgaatccagctcatcaaagaatagcacacagggggcagcttggcgggccttgtcaaagatttctctgacattggcctcagactccccaaaccacatggtgag

SEQ ID NO: 1648 - DNA, 176 bp, Homo sapiens
cctaaacgaggatttcagcttccattatgcccaactccagtccaacatcattgaggcgattaatgagctgctagtggagctggaagggacaatggagaacattgcagcccaggctctggagcacattcactccaatgaggtgatcatgaccattggcttctcccgaacagtagagg

SEQ ID NO: 1649 - DNA, 435 bp, Homo sapiens
tgtggctgtgccgttggtcctgtgcggtcacttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagaccccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattgg

SEQ ID NO: 1650 - DNA, 246 bp, Homo sapiens
ccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccag

SEQ ID NO: 1651 - DNA, 400 bp, Homo sapiens
  misc_feature (1)...(400): n = A,T,C or G
cggcaagttctcccaggagaaagccatgttcagttcgagcgccaagaccgtgaagcccaatggcgagaagccggacgagttcgagtccggcatctcccaggctcttctggagctggagatgaactcggacctcaaggctcagctcagggagctgaatattacggcagctanngaaattgaagttggtggtggtcggaaagctatcataatctttgttcccgttcctcaactgaaatctttccagaaaatccaagtccggctagtacgcgaattggagaaaaagttcagtgggaagcatgtcgnctttatcggctcagaggaggaattctgcctaagccaactcnaaaaagccgnacnaaaaattanngcaaaaagcgtnccaggagccgtnctctgacag

SEQ ID NO: 1652 - DNA, 338 bp, Homo sapiens
ctgggggtgcccatcttctgtgctctgtggtacatatctgtgtcgccaaagtagcgtgcccggtacagcaagccttccttctgctgcttctccttccagcagttgttccggaggttggcgatataatcatcttccacattccgctcgactgttttgaggctggagcctgtgtactcttcggagaaagtgtctcccacatagtagacgacacccaggtggtcagtgactcgcctgtggatgtggcccacagacggtcttggactcagactgtagggtggactggagaccatgagctggctgagagctgacacgagaatcaggatgaggataggcatcag

SEQ ID NO: 1653 - DNA, 167 bp, Homo sapiens
gcggtggagccgccaccaaaatgcagattttcgtggaaacccttacggggaagaccatcaccctcgaggttgaaccctcggatacgatagaaaatgtaaaggccaagatccaggataaggaaggaattcctcctgatcggcagagactgatctttgctggcaagcag

SEQ ID NO: 1654 - DNA, 1034 bp, Homo sapiens
  misc_feature (1)...(1034): n = A,T,C or G
atgcatgctcgagcggccgccagtgtgatggatatctgcagaattcgcccttagcgtggtcgcggccgaggtccaagagggagataanacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggctttgtgcatagtgtcttcatgtcgcgtatagttgagcgcgttcttagcagttggcttcatggacagctcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgcgcaaagcttaacaatttgtaggaaactttgggtctttttgtcccaagaaaaaggaatgtcttgacaggcttaaagcttttcgtccccttgcaccttaaaactcgaaagttaggnaaaatccctttaaagggctttttttaatagccagaacttcccaaaaggaatggcnttttagggaatttcntagccatngctttttaaatttaaagaaatttttaanaaccttgccccnggggnggggncccgctccaaaaaggggnggnaaaattccccagccnaccctttnggggggggccncgttttcctttnnnggggggaanc

SEQ ID NO: 1655 - DNA, 487 bp, Homo sapiens
atgcatgctcgagcggccgccagtgtgatggatatctgcagaattcgccctttcgagcggccgcccgggcaggtcctactcttctccgtccattgtactatctgcccgtggtggggatggcagtaggatcatatttgatgacttccgagaagcatattattggctccgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggaggacctcggccgcgaccacgctaagggcgaattccagcacactggcggccgttactagtggatccgagctcggtaccaagcttggcgtaatcatggtcatagctgttt

SEQ ID NO: 1656 - DNA, 514 bp, Homo sapiens
  misc_feature (1)...(514): n = A,T,C or G
atgcatgctcgagcggcccgccagtgtgatggatatctgcagaattcgcccttancgtggtcgcggccgaggtcctacccataatccagagaggcttgcccagaggaggactacgtgggggacgtgccaccagaaccctacttgggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagacctgcccgggcggccgctcgaagggcgaattccagcacactggcggccgttactagtggatccgagctcggtaccaagcttggcgtaatcatggtcatagctgttt

SEQ ID NO: 1657 - DNA, 605 bp, Homo sapiens
  misc_feature (1)...(605): n = A,T,C or G
atgcatgctcgagcggccgccagtgtgatggatatctgcagaattcgccctttcgagcggccgcccgggcaggtccanacgctgacattgnttctgagtccttaagcaggaaggatttgaaatcctggagcttggcagtcttgctcttcacctctaagccaatgttgaccccttcatctataaagtccacaactctccggaagtcatcctcacggaactgtcgagaagttaaggctggggccccaagccgcaggccgcccggtgtgatggcacttcggtctccaggacaggtgttcttgttggcagtgatggatacaagctctagcacccgctcagcccgagctccatccaggcccttgggccgcaggtccaccagcaccaggtggttgtcagtaccacctgataccagtgagtagcctcgccctagcagggcatctgccatggcccgagcattcttcagaacctgcagggagtactcccggaacatgggggtgcaggacctcggccgcgaccacgctaagggcgaattccagcacactggcggccgttactagtggatccgagctcggtaccaagcttggcgtaatcatggtcatagctgtttc

SEQ ID NO: 1658 - DNA, 784 bp, Homo sapiens
  misc_feature (1)...(784): n = A,T,C or G
agnnttccgncggccctcnagntgcatgctcgagcggccgcgcagtgagatgnatatctgcagaattcgcccttancgtgggcgnangcatgacgctcgggatcagaactaaaacaagtgagatcacccctctaattatttctgaactnggttaataaaagcttataagatttttatgaagcanccactgtatgatattttaagcaaatatgttatttaaaatattgatccttcccttggaccaccttcatgttagttgggtattataaataagagatacaaccatgaatatattatgtttatacaaaatcaatctgaacacaattcataaagatttctcttttataccttcctcactggccccctccacctgcccatagtcaccaaattctgttttaaatcaatgacctaagatcaacaatgaagtattttataaatgtatttatgctgctagactgtgggtcaaatgtttccattttcaaattatttagaattcttatgagtttaaaatttgtaaatttctaaatccaatcatgtaaaatgaaactgttgctccattggagtagtctcccacctaaatatcaagatggctatatgctaaaaagagaaaatatggtcaagtctaaaatggctaattgtcctatgatgctattatcatagactaaccgacatttatcttcaaaacaccaaattgtctttagaaaaaattaatngtgattaccaggtagaaggacctgcccgggcggnccgctcgaaagggccgaaattccagccccacctgggc

SEQ ID NO: 1659 - DNA, 789 bp, Homo sapiens
  misc_feature (1)...(789): n = A,T,C or G
tngngccctctagatgcangctcgagcggccgccagtgtgatggatatctgcagaattcgcccttagcgtggtcgcggccgaggtccattaaagataagtttggctaactattttactgaagagactaatggtcttccctctgttgtactgctatgtttcttgatctgtttttccccaatgtaacagtctacattgaagtcctttagctctctccatatactaattgacatttgttaaggattcaatattttgtgaattctttttacccttaaaatgcatatctttcagagagataagaatgaattttgcaataatttatatgcagagtgtgcttatgggtttctgggagttcaagttagtaccccagagtgcttaaaagtacgatgctaaattctaaggctaatgtaatgactgtagattatctatgtccacattgttcaacagaaatataatgtgaaccacaacataatttttaattttctagtagccatattaaaaaagaaacaagcaaaattaattttaataacagtttatgtaacccagtatattaaaaatatcatttcaacatgtaatcaatataaaagattattaatgaaacaccttatcctctttttcttccatgctaagtcttagatttgagtgtattttgcactcacagcacatctcaattctgactggacctgcccgggcggccgctcgaaagggcgaattccagcacactgggcggccgttactagtggatccgagctccggtaccaagcttggcgtaatcatggtcatagctgttt

SEQ ID NO: 1660 - DNA, 559 bp, Homo sapiens
  misc_feature (1)...(559): n = A,T,C or G
ccncgccctctagatgcatgctcgagcggccgccagtgtgatggatatctgcngaattcgccctttccagcggccgcccgggcaggtccatcagacttcttgggtgcctggctatattcaatgtgaagtaaaaaatatcccaagtcttacaccaaaatagaggctctgacttagaagtatgcttttagctttctttttaaataagacattctggaagaaaaaaaaagaaaaaggaaagaaaatcaagtttgaaacacagttaacacttattttggcaagaaagcaaccaaaatctaaaaagcataaactatgngtccaaatgnaaaaggnattacagaacaaactgcaagaggggaaaattaaagccncactgaacgaaaaaatacagtatgtctaacattttggaattgnaatttaaaccctaagggcaaaagctgaaaaatcatgcttanacctnggncgngaccacnctaagggcgaattccancacactggcggncgttactagtggatccnanctcggtaccaagcttggcgtaatcctnggcatagctgtttc

SEQ ID NO: 1661 - DNA, 453 bp, Homo sapiens
ttgggccctctagatgcatgctcgagcggccgccagtgtgatggatatctgcagaattcgccctttcgagcggccgcccgggcaggtctgcagtgtccctttttatatcatgctagtgttgagacatacttgactaacttgggaacagttcgatatattgacaaccgtcaacttaagaaaatcaacagcttttggccccagcgtccaagtgaacttttcatggagtgcagaatctcaaatggacaaaatactttgtctttttaaatactgaaaatttaattattagtactatgactgaaagattcttcatggctaaaaagctctgcatcaaactcaattcaggaggacctcggccgcgaccacgctaagggcgaattccagcacactggcggccgttactagtggatccgagctcggtaccaagcttggcgtaatcatggtcatagctgtttc

SEQ ID NO: 1662 - DNA, 809 bp, Homo sapiens
  misc_feature (1)...(809): n = A,T,C or G
ctcgagcggccgccantgtgatggntatctgcagaattcgcccttancggccgcccgggcaggtccttagccaaagaatgcagtggagccttcccccnggggctgcattgtgaatgaataccaattgacagcataaaaattaatagtcccatatcagatctggaaggggtttctggggctgtctgatgtccctatcctgttgtagtgaacacaatagcagaaaattctttctgggtccatctgctataaagtcttggtaaaacagcattactatgaagaggatgaactcacctaccttcanatggaggaaaagtgaaaaggacttaggctttagtcctccatgacttttcttaagcactacctacctgtaataagctgagtgcaaaaggatgccgaagaaaatctgcacccagaagctgttagaaagcactgcagangaacagggnatgaataaaataaanagntcttaataaacccttaagattctttgntcaaggggnactttgccaaaaggggcagaatangngggnaaagagttgcttttaatctagctctacactggcntttgaaaataaaatttgcccatttngaaatatatngggntataattaaaatgnggctttttacactggnggggctatataaaaactgggtagnnaaatttccaccgagcatntatggngatttgntcacagnaaacctccgggcnggacccacgctaagggnggaattccagcnacantgggggggncngntacctanagtggatcccnagnctnggggnccccnaanctttgggggngtnaatc

SEQ ID NO: 1663 - DNA, 585 bp, Homo sapiens
ttgggccctctagatgcatgctcgagcggccgccagtgtgatggatatctgcagaattcgcccttgccgcccgggcaggtgatggatgaggagcaaaaactttatacggatgatgaagatgatatctacaaggctaataacattgcctatgaagatgtggtcgggggagaagactggaacccagtagaggagaaaatagagagtcaaacccaggaagaggtgagagacagcaaagagaatatagaaaaaaatgaacaaatcaacgatgagatgaaacgctcagggcagcttggcatccaggaagaagatcttcggaaagagagtaaagaccaactctcagatgatgtctccaaagtaattgcctatttgaaaaggttagtaaatgctgcaggaagtgggaggttacagaatgggcaaaatggggaaagggccaccaggctttttgagaaacctcttgattctcagtctatttatcagacctcggccgcgaccacgctaagggcgaattccagcacactggcggccgttactagtggatccgagctcggtaccaagcttggcgtaatcatggtcatagctgtttcc

SEQ ID NO: 1664 - DNA, 999 bp, Homo sapiens
  misc_feature (1)...(999): n = A,T,C or G
anccngctcnagcggccgccantgtgatggatatctgcagaattcgccctttcgagcgggccgcccgggcaggtctgacaatngattaaacaggcgacatgcaacccccactaaggttaaaagtccaaaactactcacacgcatctcttnattggggaaaagctgagactattatncattcttggtagncttgcaaccttgcatgaagagcacccattgcatttctttcatctttcagaaagcaccggtatctgttccaagggnctaacagtacnaaaatacnttntgggattacacctttnaaacccaanactgttntcattaaaaataattttggnttgtaacaaaattatgaaatacaatgcaagcacctnggtatagcattattactgaaaccacttaattcccagctttttgagttttttaaaaaaacccactgcactaagattcacaattcattgctacatacaaattaaagctagtaagaacacactaacgtcacaagtttctcattctaaagtgcnaaanccntaatngtctngaaagtggaacaggggtaaagggcaaaaattaaccccccccaccccaattaaagtttcctggaangtcantantnttttnaatccccaaaggnnncatttctntttaaaaaaattggntacctttggaactggggtaaagnaaaatnaggaacccctgggnggttttttttatnttttcttnaanccaaccccccaattccaccttaaaaacccccacccggggganggccaaaangnccacccttgnggaaacncttttngtgggggncccggtcgnaaaacccaaccnccctntaaaaagggggggtcgnnaaaaaatttctcccnaaganaaacccacctttggggcgnggggacncgntttacccnttaaaatggggggaattccccgaaagcgtttgggggtaaccccaaaagacctttggggggggaaaaatgaatgggggnccattaaccn

SEQ ID NO: 1665 - DNA, 27 bp, Artificial Sequence
  PCR primer
gctaaaggtgaccccaagaaaccaaag

SEQ ID NO: 1666 - DNA, 37 bp, Artificial Sequence
  PCR primer
ctattaactcgagggagacagataaacagtttcttta

SEQ ID NO: 1667 - protein, 207 aa, Homo sapiens
MQHHHHHHAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDVADYKSKGKFDGAKGPAKVARKKVEEEDEEEEEEEEEEEEEEDE

SEQ ID NO: 1668 - DNA, 636 bp, Homo sapiens
catatgcagcatcaccaccatcaccacgctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtccagctaaagttgcccggaaaaaggtggaagaggaagatgaagaagaggaggaggaagaagaggaggaggaggaggaggaggatgaataatgactcgag

SEQ ID NO: 1669 - DNA, 2821 bp, Homo sapiens
ccacgcgtccgcgccgcgcggcgcaggggaggcgagaggcgccccccggtggagagcctgagccccgcgcaagtctggcggcacctggcgagcggagccggagtcgggctggggaccgcggggttgaggccggaccgcggcggggtcgggggagaaacgcgcgctgccctggcacgggccccaaccccccggccgcgcggaatggtatggcccggccggagttaaggccggggggaggcggcgagtcccgcggcggcggcgacgatggggctgcgtgcaggaggaacgctgggcagggccggcgcgggtcggggggcgcccgaggggcccgggccgagcggcggcgcgcagggcggcagcatccactcgggccgcatcgccgcggtgcacaacgtgccgctgagcgtgctcatccggccgctgccgtccgtgttggaccccgccaaggtgcagagcctcgtggacacgatccgggaggacccagacagcgtgccccccatcgatgtcctctggatcaaaggggcccagggaggtgactacttctactcctttgggggctgccaccgctacgcggcctaccagcaactgcagcgagagaccatccccgccaagcttgtccagtccactctctcagacctaagggtgtacctgggagcatccacaccagacttgcagtagcagcctccttggcacctgctgccaccttcaagagcccagaagacacacctggcctccagcaggctgggccatgcagaagggatagcaggggtgcattctctttgcacctggcgagagggtctgactctgggcacccctctcaccggctacaaggccttggactcactgtacagtgtgggagccccagttcccacctctgtgacaataggatcatggccttacccttgaagcattaccgagaaggagaacagagatgggcttgaagagccacgtgctgccggctccaaattcccaaggacaaggatccctctgcatttttgtctatgtaacctcttatatggactacattcagctgcaaggaaaggaaaaccttgattgcagtggtttaaacaaacagaagattgtttttccacatagcatggattctggagatgggtggctaatggtattggttcaacaactccacgaaggtaggggtcacgtcttggatccttttgccttaatctcagtgctcgttacttcatggtcccaagatggctgctgtatccccaagaatcatgtctgcgttcaaggaaggaggggtggaggaagaggaagggccaaactagctggacccgtcaccttctatcagaaagtaaaacctcgtcagaagtctgtttcctgctctctccctctgcatatcttcacttagatgcccttggcccgagccagctaccattgcacctctagctgcaaacaaagctaagacagcagggaacagaattgtcatggctgaatagaccaatcgtgttccatctactgagactggcacactgcctcctgcaataaaactgggatcccattaccaagagagaaatgcagaattgtgtaccagttagcttttgctgtgtaacaaaccatccccaaacttggcagctagaaacaaaccctgtattttcccacaatcctatgggttggcaatttgggctgggctcaacagggcagttctgctgctcacacctgggatccctcatggagctaaggtcagctgttacctcagctgggcctggatggtctaggatagccttactcacttgcctggcaggtgacaggctgttggctggaattgcttggttctcctccatgtggcctctccagcaggctagctcaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtggccatttttcacctatcacaaataattttggatgggtatttatttggataaaggtatttccctcttccccctttctctctgtctcatggggcctcactctgccaagttggaaggcactaagacattgtcctggccctcagggtctaggggaagaggtgttggggcaggaagtgagtctctccatgggctggacccactgtagtaggagtgcctccttgtctgcactgctggtatggggttaggccaggtaggacattccagaggggcttctgaaaaccaagagtccctggggaaagggaacagagtaaggcaggccttgttctcactgccctctaagggaacttggtcactcggcacttttaagcctcagtttctccagttcaataataaggacaagagcttttcccatgcattctctttccccgggaaagttgactgaggtgaccagtaatagaattgaaaagggagagtgtcttcagtgcaatgtggcatcctggattgggtcttggaacaaaaacaggacattagtgggaaaattggaaatctgaaaaaagtctgaattttagttaatataccaatttcagtctcttggttttgacagatgtaccatggtgatgtaagatgttgaccttggggtaggctgggtgaagggtatacaggaactctttgtactatctctgcaacttctctgtaaatctagtatcattccaaaataaaagtttatttaatttaaaaaaaaaaaaaaaaaaaaaaaaaaaaaaaaaaaaaaaaaaaaaaaaaaaaaaa

SEQ ID NO: 1670 - protein, 137 aa, Homo sapiens
MGLRAGGTLGRAGAGRGAPEGPGPSGGAQGGSIHSGRIAAVHNVPLSVLIRPLPSVLDPAKVQSLVDTIREDPDSVPPIDVLWIKGAQGGDYFYSFGGCHRYAAYQQLQRETIPAKLVQSTLSDLRVYLGASTPDLQ

SEQ ID NO: 1671 - protein, 109 aa, Homo sapiens [sequence omitted]

SEQ ID NO: 1672 - protein, 145 aa, Homo sapiens
MGLKSHVLPAPNSQGQGSLCIFVYVTSYMDYIQLQGKENLDCSGLNKQKIVFPHSMDSGDGWLMVLVQQLHEGRGHVLDPFALISVLVTSWSQDGCCIPKNHVCVQGRRGGGRGRAKLAGPVTFYQKVKPRQKSVSCSLPLHIFT

SEQ ID NO: 1673 - protein, 117 aa, Homo sapiens
MDYIQLQGKENLDCSGLNKQKIVFPHSMDSGDGWLMVLVQQLHEGRGHVLDPFALISVLVTSWSQDGCCIPKNHVCVQGRRGGGRGRAKLAGPVTFYQKVKPRQKSVSCSLPLHIFT

SEQ ID NO: 1674 - protein, 90 aa, Homo sapiens
MDSGDGWLMVLVQQLHEGRGHVLDPFALISVLVTSWSQDGCCIPKNHVCVQGRRGGGRGRAKLAGPVTFYQKVKPRQKSVSCSLPLHIFT

SEQ ID NO: 1675 - protein, 102 aa, Homo sapiens
MQNCVPVSFCCVTNHPQTWQLETNPVFSHNPMGWQFGLGSTGQFCCSHLGSLMELRSAVTSAGPGWSRIALLTCLAGDRLLAGIAWFSSMWPLQQASSGLFT

SEQ ID NO: 1676 - DNA, 1336 bp, Homo sapiens
ctctaagcagcatgtaacctggcctgcatccaggaaatagaggacttcggatccttctaaccctaccacccaactggccccagtacattcattctctcaggaaaaaaaacaaggtccccacagcaaagaaaaggaataggatcaagagatacgtggctgctggcagagcaagcatgaattcgatgacttcagcagttccggtggccaattctgtgttggtggtggcaccccacaatggttatcctgtgaccccaggaattatgtctcacgtgcccctgtatccaaacagccagccgcaagtccacctagttcctgggaacccacctagtttggtgtcgaatgtgaatgggcagcctgtgcagaaagctctgaaagaaggcaaaaccttgggggccatccagatcatcattggcctggctcacatcggcctcggctccatcatggcgacggttctcgtaggggaatacctgtctatttcattctacggaggctttcccttctggggaggcttgtggtttatcatttcaggatctctctccgtggcagcagaaaatcagccatattcttattgcctgctgtctggcagtttgggcttgaacatcgtcagtgcaatctgctctgcagttggagtcatactcttcatcacagatctaagtattccccacccatatgcctaccccgactattatccttacgcctggggtgtgaaccctggaatggcgatttctggcgtgctgctggtcttctgcctcctggagtttggcatcgcatgcgcatcttcccactttggctgccagttggtctgctgtcaatcaagcaatgtgagtgtcatctatccaaacatctatgcagcaaacccagtgatcaccccagaaccggtgacctcaccaccaagttattccagtgagatccaagcaaataagtaaggctacagattctggaagcatctttcactgggaccaaaagaagtcctcctccctttctgggcttccataacccaggtcgttcctgttctgacagctgaggaaacgtctctcccactgtttgtactctcaccttcattcttcaattcagtctaggaaaccatgctgtttctctatcaagaagaagacagagattttaaacagatgttaaccaagagggactccctagggcacatgcatcagcacatatgtgggcatccagcctctggggccttggcacacacacattcgtgtgctctgctgcatgtgagcttgtgggttagaggaacaaatatctagacattcaatcttcactctttcaattgtgcattcatttaataaatagatactgagcattcaatgtgaaaaaaaaa

SEQ ID NO: 1677 - protein, 250 aa, Homo sapiens
MNSMTSAVPVANSVLVVAPHNGYPVTPGIMSHVPLYPNSQPQVHLVPGNPPSLVSNVNGQPVQKALKEGKTLGAIQIIIGLAHIGLGSIMATVLVGEYLSISFYGGFPFWGGLWFIISGSLSVAAENQPYSYCLLSGSLGLNIVSAICSAVGVILFITDLSIPHPYAYPDYYPYAWGVNPGMAISGVLLVFCLLEFGIACASSHFGCQLVCCQSSNVSVIYPNIYAANPVITPEPVTSPPSYSSEIQANK

SEQ ID NO: 1678 - protein, 177 aa, Homo sapiens
TRPRRAAQGRREAPPGGEPEPRASLAAPGERSRSRAGDRGVEAGPRRGRGRNARCPGTGPNPPAARNGMARPELRPGGGGESRGGGDDGAACRRNAGQGRRGSGGARGARAERRRAGRQHPLGPHRRGAQRAAERAHPAAAVRVGPRQGAEPRGHDPGGPRQRAPHRCPLDQRGPGR

SEQ ID NO: 1679 - protein, 42 aa, Homo sapiens
LVCCQSSNVSVIYPNIYAANPVITPEPVTSPPSYSSEIQANK

SEQ ID NO: 1680 - DNA, 717 bp, Homo sapiens
  misc_feature (1)...(717): n = A,T,C or G
aaaagaatttttgctttctttntctctaaattttccttccgtgctttgatgcgggctcgtttctcacgttccagtctgggaaaatggtccacataaggcaaggcaaagaatcgtttcctattgtatcttttatttaggtgccaaggtataacccactgcttgaacttgtgccagatgattcttccaaagatgtctcttctccaagcaccaggtctagctctttcttgaccagtctgaagaagccttagggcatcttctctttcctggacaactttatctaatgcatccatggaatctactaccttatctaaccgctctggacttggcattggcaatctctgccgcttggcctcctgctctagggttagaagcatgtttctttctttcagtaagacataccaaagtttgtgtaaatcttcattacttttgttccttagttgctgacaggtccatgctgctccagattttactttttcttgcccccagttttttgggtcatcaaaaaattcttctagtcctttccttgacaatgtggtatgaagtaatctatattggtgaaaggatgtcacatttggtgtactcttangcaacaaactaagaaaaaaccctgtcaggcagggacctgaggagttattaacgaaccgggaagaattcagggcggatgaaactctcctaccaagaaagggncaaaccgggccgcagccatgttttccncat

SEQ ID NO: 1681 - DNA, 305 bp, Homo sapiens
ctgtacatttaacaaaatatgtgcaagactgtcatggtgaaaactacaaaacaatgataaaagaaattcaagaaaacaaataaatacaggggtatactatattcatgaattgggagaatcaatatcattattaagtctcctcagattgatctatagattcacagaaatcccaattcaaaccctatcaggactatttgtagaaatagacacactgatgataaaatttacatagaaacacaaaggaagcagaatagccaaaaattattggggaaaaaatgtagttgaaggattcccattactccttt

SEQ ID NO: 1682 - DNA, 498 bp, Homo sapiens
aaattacactccataaatttagacatatgtctctccaagtaagtacgagctgattgggaacgggctccaatggacatggctctgcagtcaaaatagttagcagatggacaggtttggaaaatgtgagggcccatatcatcataaccagcaataaggagaccaacaccatatggtctccggccatatcgttgtgttggtatctgggtctcttagactggttaacgagcttgttttaacaaggaatgaagtactgtctttattttcaaattatacattattaacaaaggtctctggcttattctttaattgttgcataatccaccagagaaataatgcaataggacactatttctttggcctaatataaaatgtttgactttctaccgaacctaagaaagagtgccagcaaaataatttcttcccatctaaaacctgatttgttttggatacaagggggtctaggatttcttgggacatctagaaccattaagaaacttt

SEQ ID NO: 1683 - DNA, 322 bp, Homo sapiens
aaaaattaaaaatagcacaattctacaattctgattttaccaagaaaataaaccttttttggcacatattatcctatgaaaatggaaagctgagtcaggctgctctgcttttcacagcacaaataagcattcatgctatcagacttgggaaattaactcggtgacaaaaattcactggaaaatagaatccttggaaaaatggggtcaggtgccatccactgagaggcaatgataatgtgtgtccttcgttattagcacaaagttaggcagcacactataattttagctacatgcaactctataggaacacatgtgggtaagg

SEQ ID NO: 1684 - DNA, 293 bp, Homo sapiens
  misc_feature (1)...(293): n = A,T,C or G
aaaagatgctgcttccctgttttcttccaggaacacagagaccaacacggnttcaaacacagggcgagcttctcactatttcctgggaatgttacttctcagcccaacacttctcttcccaagaagttcaagttttgagactgtttttctccccggaacagtacttaaaaaaaaaaaaatcnttgatnttcaaanatgggttnttttcgtgtcctggaanagcatcagtaactaaatatcaagttntccacaatgctgccccccctggggggctaaccggatgccaagggaga

SEQ ID NO: 1685 - DNA, 390 bp, Homo sapiens
aaattgtctaactcctatcccagtttctttttatagtctaaaaacaaggaatcacccaagtaagatactccttcagagcactgctgaaaacggatcaaacgtagagatcccccagatccctgttctcaagtgttaaaaatattttatattagcacatagaatacccttagatatattctgttatgttctaaagagtttgtgtttccccctttttgatgatgtcttcaatttcttctgagacctttcctgtatagtcatttggttctattgcttttaacttctcttgatactccagcggcaaaccattttcttttgcacccatgcaaataatctttttatactgtggggatgggggagcactttcgtaatttgtcatcagataacttcgac

SEQ ID NO: 1686 - DNA, 549 bp, Homo sapiens
gggtccagtccaacctgctcctcattattgtaaacatgtgcagaatcaatatggtggaacccggcttctattgccaatttgacggcctctagagctttacttttaggaacctgggggagcaaccaaacgtaatattttctgactaatgtgcctgagagttagttcgggcacaagcagcaacgttcacaaaaatcagcttttcctcctttcttggatgagctctgtatgtagaatcataagcccatcccagtctgactgggtctttcccatttagtaataaaggttgggcatagcaggaacttctgcagtcccagaaaaatcactgaaagtggaagtgtccccaaaacaatttcactttcagtgattttttggaaaaatcaacaggacgcaactatagttacagacataatcttaattatttttagtatggtgaaattaacacaaggaaatagccacatggaaggaattatgaaggaatgcagtgtaagctcctgtgattcctctcccaccatgttgcacagagcgcactgactttatccagcatcatat

SEQ ID NO: 1687 - DNA, 442 bp, Homo sapiens
  misc_feature (1)...(442): n = A,T,C or G
caactgcaaatgaagatcctttttggatacttgntgagaaagacacattngggggggggttgtgacnaaaataacgatggccggcttgatccccaagagctgttaccttgggtagtacctaataatcagggcattgcacaagaggaggcgcttcatctaattgatgaaatggatttgaatggtgacaaaaagctctctgaagaagagattctggaaaacccggacttgtttctcaccagtgaagccacagattatggcagacaggctccatgatgactatttctatcatgatgagctttaatctccgagcctgtctcagtagagtactggctccttttataatttgttaccagctttacttttgtgataaaatattgatgtngnnttttacactcttaagtcttaaccacagtcacaattatcttaatgtagatnataattg

SEQ ID NO: 1688 - DNA, 340 bp, Homo sapiens
  misc_feature (1)...(340): n = A,T,C or G
ctgccagctaacagcaagagctntgagggcatcactgaacagatagcacctnatgngntntnatgattcaaaaatctcccttgctgttggatttaccaacacgtaggcttttatttcttcccattacatctgtttagccacagaaagcatcgggccatactcactgcagaagataagacttcctcagaatcttatttgtttagtgcactcaattttacttcactgtctcatcacttgagagactggttaaggcaagaaacccatttcttaacattttttttgttttcaaacatttgaaaagcaacaccaaaacgtatgcagttaattcctcaattctttc

SEQ ID NO: 1689 - DNA, 140 bp, Homo sapiens
  misc_feature (1)...(140): n = A,T,C or G
ccagagggcctgcacatgcaatttccagtccctgccttcagagagctgaaaagggggcctnggtcttttatttcagggctttgcatgcgctctattccccctctgcctctccccaccttctttggagcaaggagatgcag

SEQ ID NO: 1690 - DNA, 485 bp, Homo sapiens
gagattattacccagaattcacatgtagggatggggaaggacaatttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgttttttttctcaactagttaagtcaactgcttctgaaataactctgtattgtagattatgcagatctttacaggcataaatattt

SEQ ID NO: 1691 - DNA, 342 bp, Homo sapiens
  misc_feature (1)...(342): n = A,T,C or G
gaagaaacaangatgacttttttnanaacaaagcataatgctggcaatnnngnggggggtnnagttttccaaacatgttatcttaaatacccctttatccttacaggttgacataactttgaatgttttaacagcaagaatnttaagaaaagataaacaccattttatttatntataaaaacaaaattanttncaaatatttttgacattgtgattttttttttccacatttctcagcaaanctaatggnattttaatcattatttttgcctgtcataagaaaactcttanctgaaatggccnnaaaactgtganacatgctatggaanctgaatgccggac

SEQ ID NO: 1692 - DNA, 450 bp, Homo sapiens
  misc_feature (1)...(450): n = A,T,C or G
aaaaatggggccccaaagactgntaagagctcatccccgtggtctcctatcaccggggnnggggttcatgtctgatgagaagcttggacggtactgaaactcatacatgtaggtgggtgctccagcatctctgtggttccgggccacaatcacagatgggacaccaaacatcacatctgctatcaagtccaggaacaggtctttctttttgacagtgtcgtctgttcctcctaagtatttctcagtggcttctggaatcagttccttagcaatgcaaacaaggggataggacttccacaggagtgacatggctgtcttctggtccagttgcccttcggagagtggatagctcatcaactgcattggaatcaaccagccaaactcctgcttgttaattccgaccatgtangggacagngtggaaattcctttcagcttgaaagctcttcag

SEQ ID NO: 1693 - DNA, 436 bp, Homo sapiens
  misc_feature (1)...(436): n = A,T,C or G
ctattttattaacatcatgntttaataaataactggctacttctaataaanngggggnctcngtttacaacagcccccaatattccattttgaccactctgcagaatttggtgtaaaaagttgaatgaaatgtagaccctgagctatcaagtaattatgtttcaatataaaaatagagaattactcttacaactgaagattgaacaataacacaaacaacctctttgtgggttttaggttcggtaaaattagttgggatcttaatggctgtctaaagcaggaaganacagaattttaatctttctgaagacttctgggaactnctttgaaagngatttgttaccttatcagagtttatgagctattattttggtnaaggcacaangaaaggattcccangnngttgntantcttttgccctggacnacaaanattg

SEQ ID NO: 1694 - DNA, 313 bp, Homo sapiens
  misc_feature (1)...(313): n = A,T,C or G
attatctgcaaggtttttttgtgtgtgtnttngnttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgttttt

SEQ ID NO: 1695 - DNA, 522 bp, Homo sapiens
ccattttcaggggaagcttgggagagcaatagtatggtgagccccttagagatgagcgcctactccttcttggcgaatgctgccttcagatgcttaccaagtggtcactgcatctagtaagattatatttccagtacacttccttagggcagaaacaccatcctatcaggtttggtcagtcccttcttcatgaagggagtcatggggaattcctgaaaattttcttccttctgcagacagttggatgagtcccttagagaaggcatccagagacataactaaactgaatatcatcccatattgattttaggaattgactctaaaactctgtgcagaatcttgtgttgggattgtatcttgacattcctgttgtgttatttttcttaactggagtgtgtgctgcctttcaggtacaatttttgtgtaataaaagccagtgcattaagtttatatagactactttctatgcaagactgagatatggaatagataggaagagatatgtactgctgggtacatgga

SEQ ID NO: 1696 - DNA, 174 bp, Homo sapiens
  misc_feature (1)...(174): n = A,T,C or G
ccagccattgcctggcatttggtagtatagtatgattctcaccattatttgncanggaggcagacatacaccagaaatgggggagaaacagtacatatctttctgtctttagtttattgtgtgctggtctaagcaagctgagatcatttgcaatggaaaacacgtaacttgttt

SEQ ID NO: 1697 - DNA, 561 bp, Homo sapiens
  misc_feature (1)...(561): n = A,T,C or G
ctgtaatgttattgcagatccncatctctcgctcaactgttaatgtctcaacctnnagaggcaccccacccagcacactgtcagtaaaggggcagattgaaacagtgagagttaagggtacagtagaaaattctgcatgtttgcagtgactagaatcagatagtagtgtggtggtttttttttttaatcattatgaanagtgggagcttgcaggtaaggcttctgtggtggtttgaaaagcagaaagcaataaatgaaacaaagngtttgtgtaatatattcctgccttgtcttcttcactcagagttgaaataggttttgcagtaaagctggaaaaaaaaagaaaacaaatgttcaaaactgtgtgtgttggngggnggaatttcctttgcttatagnagtttcagagnaactatatgttttttttcctttctttttcacaggcacagaaaactgaatctgtanataacgagggaaaatgaattgcatgaaaaattggggttgattttatgtatctcttgggacaacttttcctcggccgcnaccacnctaagggcgaat

SEQ ID NO: 1698 - DNA, 267 bp, Homo sapiens
  misc_feature (1)...(267): n = A,T,C or G
cgaggtctgccctcgattgtgtatttctgttggatcaaacactcccatgttaccactnggcnncataatgtatcgatatatattccaagtggcaacaggtaagttgagaaggaagatgaaccagtgcaatgacatgagcagtaatacagtgacaatggtatggccacttaaattaaaaatataacaaaattgaaaaatagacatataaccaaaaagattctaaatcttgcaaggaaaaaaagaataaagctgccaataagttatttt

SEQ ID NO: 1699 - DNA, 449 bp, Homo sapiens
tgttaagattttttttgctacaaagaggaggtggcaatggtagatccacccttatgcttctcagtttagcataacctcttatggattttcatcaaattcagcgtgttggtcactggaaagagccttttccttctccttttcttactctcccctcatggtgttcccctcttaaaggagaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcag

SEQ ID NO: 1700 - DNA, 398 bp, Homo sapiens
acatttcacaaataagatgtagctttccaaacaaatccattcgatgaccattatcacaactatattttattctaatttataaaacaaaaaatggttagacaagcacatgatatcaagagtcttcaacacagtggattccattttattaagaaaaaaaatagaaaacaagtagtccttaaattgtcttagctctccatagcatacgttatataaaattaaagttttgcttccaaaaatatgtttccatgtggtcgtggtgttgtccagtgctattagggccaaagcaccaaagacatgagaagtttaaccatcgacttgtcatttttcataaaagctaaacatttccttataggtctggagtaaaatcttctaggcattttagtgctaaaagtcacttt

SEQ ID NO: 1701 - DNA, 257 bp, Homo sapiens
  misc_feature (1)...(257): n = A,T,C or G
aaanaacactannggaccttagagatnataactgtttgataatttgnctcagncgtattgncntaaaagatatatnnnnggggggnnnntcnntgtnaanngntgtttggattgcctgatattatancnnggnngttgggnnntatntnacncantatacctcngncgcaaccncgctaatggcnagnatcatnacactggcngncgttactactggatncgagctcngtgccaatnncnncgtcntcatngcccta

SEQ ID NO: 1702 - DNA, 526 bp, Homo sapiens
  misc_feature (1)...(526): n = A,T,C or G
acctaattnattgaagtaataaccaaataattttcaatcttgattcaactgtgattcaaatcttacaccatttgcccacttctatgaattttatgtataaaattttttaagagtcagagttttttttcttgattaattggatgtatttcacagaatttccaactgctcacgttagttttcttccttttagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatggttattcagaatcttctgtgggaaaagaatgtgagaaacaaggacaatcactgcatggaggtcataaggctgaagggattggtgtcaatcaacgacaaatcacaacgagtgattgtncaggggggtccatgagctctggtgatccgggaggagactccaatgagctg

SEQ ID NO: 1703 - DNA, 116 bp, Homo sapiens
gacctccgaactgagctctaatttagctgatcagattttgcttgggtaaagttcctttttaatgttctaaagtgtttacggttctcaaatatcagttaaaaactaattttaggtgg

SEQ ID NO: 1704 - DNA, 241 bp, Homo sapiens
  misc_feature (1)...(241): n = A,T,C or G
aaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgtgttttttttttttttnaaggggctttgtttttttttntcaanaaaaat

SEQ ID NO: 1705 - DNA, 336 bp, Homo sapiens
  misc_feature (1)...(336): n = A,T,C or G
ggtcctgtntanacacacatcaatatgaaacaaaaaaaatttatataaataagtcaattaaacttcacaaaaactaaagaaacacaagacaaaaatccaacaagcaataaaaactgtacaatattggtcagtcttttatatctgaaaaatgtgtaacttaaaaaaaagttatttatcgtataaaaaaagtcttttacatctgtgttagctggagtgaaaacttgaagactcagactcagtggaaacagatgaatgtccacctcgctttcctttggagaggatcttgaggctggaccctctgctcacagaggtgagtgcgtgctgggcagaggtttt

SEQ ID NO: 1706 - DNA, 107 bp, Homo sapiens
agggtggctctgggagcagttgtgctgcgggcttgctgggggagaactctaactgttgcagaaacagagcttcatggcttgcttaaattacttagctggaatatttt

SEQ ID NO: 1707 - DNA, 512 bp, Homo sapiens
  misc_feature (1)...(512): n = A,T,C or G
ttttttgtctggtaattatatatttattatttagcaaaactgaagaaaaaaagcacagaattgtttcaacagatgtctctcattttcagctagcatttctctcccaagttgagctggtttaatgtgttttggatttccctcctcaattggcttattttttagatcacctgcaattcatttgcaaattgcaataaaacacattttagaaaaaaggaaccttcaattattagctttgtttctttttaaatgtatatattttgactaatgtttgtgaatgaagttggctaacatgtatttagtttcattttggcggtatgtaatataaagtttttaaaattttaaatatggttttaacctttatgtgtaaatgattttctagtgtgaccttctaatttaatattagacgtctaaggtatatctgtaaattagaatccgactatcactctgttcattttttttgaacaaagngnttaaagaaagcctgaaccagggaaaaaaaaaaaaaaaaaaaa

SEQ ID NO: 1708 - DNA, 203 bp, Homo sapiens
  misc_feature (1)...(203): n = A,T,C or G
aatcttctaaaggaagaacagacccccnagaataanattacagttgttggggttggtgctgttggcatggcctgtgccatcagtatcttaatgaagactataatgtaactgcaaactccaagctggtcattatcacggctggggcacgtcagcaagagggagaaagccgtcttaatttggtccagcgtaacgtgaacatcttt

SEQ ID NO: 1709 - DNA, 271 bp, Homo sapiens
  misc_feature (1)...(271): n = A,T,C or G
ngttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttcttcag

SEQ ID NO: 1710 - DNA, 239 bp, Homo sapiens
  misc_feature (1)...(239): n = A,T,C or G
tacaaaatattttaattgtaagtggtcagaggaattcttctggtttctcccttatggntatttttaatttgtacaatagttgcttctgtcaactcagcgacaatgccatcatagctttcaaatgagatcaccctgtagatcgatggactatgccttaaagttgcagatgcataaaggagactgaggacaaatggtgaaaactgtagttactgaacccaaatgttactcagagatatcaa

SEQ ID NO: 1711 - DNA, 122 bp, Homo sapiens
agtgtaagtgaacacagaagagtgacatgtttacaaacctcaagccagccttgctcctggctggggcctgttgaagatgcttgtattttacttttccattgtaattgccatcgccatcacag

SEQ ID NO: 1712 - DNA, 169 bp, Homo sapiens
ttcccataaataaaagtacagttttcttggtggcagaatgaaaatcagcaacttctagcatatagactatataatcagattgacagtatatagaatatattatcagacaagatgaggaggtataaaagttactattgctcataatgacttacaggctaaaattagtttt

SEQ ID NO: 1713 - DNA, 392 bp, Homo sapiens
tgacagagaggatggcgctgtcgaccatagtctcccagaggaagcagataaagcggaaggctccccgtggctttctaaagcgagtcttcaagcgaaagaagcctcaacttcgtctggagaaaagtggtgacttattggtccatctgaactgtttactgtttgttcatcgattagcagaagagtccaggacaaacgcttgtgcgagtaaatgtagagtcattaacaaggagcatgtactggccgcagcaaaggtaattctaaagaagagcagaggttagaagtcaaagaacatattcttgaaagttatgatgcattcttttgggtggtaacagatcataaagacattttttacacatcagttaatatgggattattaaatattggctataaaa

SEQ ID NO: 1714 - DNA, 301 bp, Homo sapiens
tgggagggatattttcccacaggaacaagggtctccgtgatgacacggggtctctatagtcatgttgagagcctaatggcccttggcataattgctggtgttggggtagaaggtgtcttggagtttgctcaagtggttgagagggagggaggtgccatagacttggaggaactggcacgaagccaaggatacaaatccaggcagggctgtggggcaggatagggagcagggccttctactgaaggagtgactcaggaaggaggaggggaaggtgacaagcccctgggcaggagccctgtgg

SEQ ID NO: 1715 - DNA, 194 bp, Homo sapiens
taaattcaggctaacttctgaaaatcccgttttattcacctcactgtggtaccagtaactatactgagtcaggttactttacagttaactatgtcacctaaaacacaataatccattaacactctaataacagttattgggtgtggtcatactggaaattcttaaccatatagttgtcttgccaattttttttt

SEQ ID NO: 1716 - DNA, 185 bp, Homo sapiens
gtaggaatgggttcttggtacacaagatagtattgttgagctagttttcgagctctgtgcacaagcactctttaattcccacggacggggctcctccagctacagcagccaaagcatattcaatctggacaagtttaccagacgggctgaatgtagtcagcgaaaaactgtacccgcgctccgcc

SEQ ID NO: 1717 - DNA, 296 bp, Homo sapiens
  misc_feature (1)...(296): n = A,T,C or G
aanaggctcttggtggagaggactgtgaagccgtcggcaggtgtgccctcggttgtgccgtcggcgctggctgccttactgacttcaccctgcttcttcttggatttccgggcccctttcttgcctcctgcttttttagatgcaggcttcttctgggatggagacttggcctttttggctgggggtggtgtgatgatggcttccaactttcctttggatccccgcttcttcgctagcaactcggggtggatgttgggtaacacacccccactggctatggtgactccttttagcag

SEQ ID NO: 1718 - DNA, 343 bp, Homo sapiens
  misc_feature (1)...(343): n = A,T,C or G
atggcattaattgttccttgcttttatagggtgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattntgaatacacatctctgtcagtgtgaaaattcagcggcagtgtgtccatcatattaaaaatatacaagctacagttgtccagatcactgaattggaacttttctcctgcatgtgnatatatgtcaaattgtcangc

SEQ ID NO: 1719 - DNA, 193 bp, Homo sapiens
tcgaggacccccgagatgcagaggatgctatttatggaagaaatggttatgattatggccagtgtcggcttcgtgtggagttccccaggacttatggaggtcggggtgggtggccccgtggtgggaggaatgggcctcctacaagaagatctgatttccgagttcttgtttcaggacttcctccgtcaggcag

SEQ ID NO: 1720 - DNA, 176 bp, Homo sapiens
  misc_feature (1)...(176): n = A,T,C or G
tgattcagaattttttttaatgaaaggatnattgcactaaccttcttcctgctgctctgattctgcatttgtggtacttgtgactacgttntttcaaatatagatagatttaagctgctaatttttttttttttagtaaccactnctatatcatgtcttttactctgntnataata

SEQ ID NO: 1721 - DNA, 128 bp, Homo sapiens
  misc_feature (1)...(128): n = A,T,C or G
tattcttangaaacttccctaatcccttggaaattcccgggtccttcaagaataaaaaaaaaagggtcaagaagaacaaattaccaaagggaaagaatggctttcaatataataaggtccatttttta

SEQ ID NO: 1722 - DNA, 285 bp, Homo sapiens
  misc_feature (1)...(285): n = A,T,C or G
ttatgaagttgacaaataaataaaaggtagtggntatgtctgagcttattgtgtttgagctaacaccaggttactcagtaaccatgacctgctcctccatttccatttattctcaacattaaatagttttatcttgttgntgccagaaatgcacttgtgccaggnattgnccctgctgtatgaaaagcttcttggcaatgaattctgtaataagtgccctacattatggntttctggtggaattggtttaacagngacaacccaggatttccaatatatttttgt

SEQ ID NO: 1723 - DNA, 536 bp, Homo sapiens
  misc_feature (1)...(536): n = A,T,C or G
cttggcttgcaggtggcaccttctcactatgtnctcacatggccttttctctgtggagagggacannnagcatgagcaggctctggtgtctcctcttcttataaagacactaatatcaccatattagggcttaaacctatgacctcatttaaccttaaccccttaaaggtcccatctccaaaaacagtcacatagcaggctactgcttcaacatatgcatttgggggaggggacaccattcagttcttaacagggtggtcaccgcaaacatggaaagtcagagccttctccccttcagaattcccgcccccacccagggatggggaagaggagcagagaggtatgggaagcagacacggagagtggcaggtaccatgctggggtgggctcaggagtgctttcgganggacatatggaactggcagggctcaatgcanggagggcggaagnccttgggaagancccgtggcctgagaaaggggctgggctacaaccctnggcaagttactttaccnntgaccttcgatgcttttggg

SEQ ID NO: 1724 - DNA, 145 bp, Homo sapiens
  misc_feature (1)...(145): n = A,T,C or G
ctgnccttttgnaacaggaccctcacnctatncaatggggggttnanntgaagcatgancntatncatgcggaaaacccaactcatgtgagcncaaancggancgacccagacaaccatgnatgcggctaatatggggagagaaa

SEQ ID NO: 1725 - DNA, 173 bp, Homo sapiens
caattctggaattacccacttgtttaattttgagcaacatgatctagcattaatgtagtcacattctaaatcagacaatgtaattatgaagtagaccgagaggaagatgagcgcgcaacaatcgaggagagagaagacgaacaccaccgcctccatcctcctcctccgtcgcc

SEQ ID NO: 1726 - DNA, 302 bp, Homo sapiens
acccgttggaaatgggccatggtctaatttggtgttgaaataaactaacctctttggctgtttctcccaaactgccaccagccaggcaaggccaatccaatactgactgctggctgggggagctcgtaatgggtgatgccgccctgctttttgcatatgtcaggctaacaggtgctttatttccagagaattgttaatgcccttttttgaaaagagcagcagaaattccggacaagaatctgaaaaataggtgtcaaaaactatttcccagaaggtagctgtacaggagtttgagtctccag

SEQ ID NO: 1727 - DNA, 274 bp, Homo sapiens
  misc_feature (1)...(274): n = A,T,C or G
ttnngttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttcttcag

SEQ ID NO: 1728 - DNA, 415 bp, Homo sapiens
aaatccctttctgcttccactggaggcaaaactgaacaaaatgttagttaaatagagagagcagcatttctaagaaatctgtggtcagcattatagaccatctatgctacaaggatgtcattaaataggatttgttcaattactggattcttcttctatgatcagttatagaatttctggtttatatctctgattcataaaactgggactccactttttgaagatacatctgattgatttttttcagtcatgatttaacagacttctttgagatgctcattttaacatttacataatttataatcccaaatgtataaaagacaatgaaaaaagcatcataaataaataatgcaaaatgaaatagttatgtcagacttttggaccttctgataaattagcaaaactgtaacagaaa

SEQ ID NO: 1729 - DNA, 309 bp, Homo sapiens
  misc_feature (1)...(309): n = A,T,C or G
acanaccgtatactttatgcaaacaaagtgatgcctcactgacttaggagacaagtcacatgccatcagtgtgtcagaaaatttctttcttcagtgatagttaaggtaacctcgccagctactttccagagacagctccagggcaatactggggaaaaaaaaatcagagacataggaccccaatagagccctgtgcaacaaaaagatgctagataacaaaactcaaagcaaaactaagatcattccaatttaggggaaagtttttttattcagtgtttaagattaaaaactacaagattttgcttgcag

SEQ ID NO: 1730 - DNA, 285 bp, Homo sapiens
  misc_feature (1)...(285): n = A,T,C or G
anctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgctccatgggagagtattttagagacaatggcaaacatgctttgatcatctatgacgacttatccaaacaggctgttgcttaccgtcagatgtctctgttgctccgccgaccccctggtcgtgagg

SEQ ID NO: 1731 - DNA, 244 bp, Homo sapiens
cattaccttgctaaaatttccactaagctacagcttcagatatttacaagaaaaataaatatcttttaacagacttcaatgtggtttaacagcaagctagctgaggagttgtattttgttgttatttcaggtaactttttattaagaaacagttaatatttcagcgattacaatttcaggtgttcaaaactcaagaagggtcatcattatactctgaagcagaattcttcaggtactcatcttt

SEQ ID NO: 1732 - DNA, 272 bp, Homo sapiens
  misc_feature (1)...(272): n = A,T,C or G
ctgggaagncagttcgttctctcctctcctctcttcttgtttgaacatggtgcggactaaagcanacagtgttccaggcacttacagaaaagtggtggctgctcgagcccccagaaaggtgcttggttcttccacctctgccactaattcgacatcagtttcatcggaggaaagctgaaaataaatatgcangagggaaccccgtttgcntncgcccaactcccaagtggcaaaaaggaattggagaattctttatgttgtcccctaaagat

SEQ ID NO: 1733 - DNA, 388 bp, Homo sapiens
  misc_feature (1)...(388): n = A,T,C or G
anttggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatgggaccatatttattacagttttt

SEQ ID NO: 1734 - DNA, 282 bp, Homo sapiens
tttggaatgtaaaattaatggtatctggtatcaagttgtaagaaaaactcccccagattgggaggtaactgagtgatatgtgaaagaatcttcccgtctgaatttaagaatacacctacactgggcagaaaaaggtgggggagaggaagtagaagtagaggaaaagcacaactccactggcttcaatcaaactgaggtaactaattagagacggaaaataaataaatcaacaaatgccccatttttgttttccaaaaaagatcactggcaactaacaatttt

SEQ ID NO: 1735 - DNA, 268 bp, Homo sapiens
  misc_feature (1)...(268): n = A,T,C or G
ntaagccagccttcctcaagaatgccagacagtggacagagaagcatgcaagacagaaacaaaaggctgatgaggaagagatgcttgataatctaccagaggctggtgactccagagtacacaactcaacacagaaaaggaaggccagtcagctagtaggcatagaaaagaaatttcatcctgatgtttaggggacttgtcctggttcatcttagttaatgtgttctttgccaaggtgatctaagttgcctaccttgaattttttttt

SEQ ID NO: 1736 - DNA, 478 bp, Homo sapiens
  misc_feature (1)...(478): n = A,T,C or G
tnatagacttttccaatggcccccttataacaccagaaaggattgtaatcttgggcgtattttgtgctggcatctttggcagttgtgaagatcttgtaccagagcgtggcgttgctgtacgtgtcaggaacacagtgcggtggctgtacagtgacggggaacaccccagggctggccgtgagggtcatgcaggctgtgaataccacctgctcacagtgaccgtggagggcgcagtcatctgagctccacgctgtaggcagggtgaaggtgatgtttatctcctcgtgggcttccctgcctgaaagtccaatctgatgccctaagatggttgagtacagatgggtgacgttgcgggaataccctccgaagggtttcagtgggtccagggttagggtgattgagactgagatattcaccgggcccgagtcctccagggcctggggggactgggtggaagctcgggcctgcccgctggtca

SEQ ID NO: 1737 - DNA, 489 bp, Homo sapiens
  misc_feature (1)...(489): n = A,T,C or G
ctttnaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttgg

SEQ ID NO: 1738 - DNA, 262 bp, Homo sapiens
gttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacacggatcctggtgataagagaaattcaggaggccatcgcagtgg

SEQ ID NO: 1739 - DNA, 422 bp, Homo sapiens
ccaccatccttttgagacagttcctatcaacaatcttgaaccatactaatacattacttgttcctgaagtccttttgttgtagctcataataaaataagcaatacaaatgaattatctgtatttaagggaaaagaaacatttacaagaaaacacaaaaatataactgttataattcattatgaataaatatacactttgaactggctaagtacaatctttatacattgtttaagatttaatacagtttattagccattttcttttttcacacaatgtatatcaaaattaaaaaaaaatactgatttatagaaaaatggcaaagtacagtagttccattccaatttgaagggccatgaaaagccactgcaagaccttttagcctaattcaaacctgtaaacatgttcagtcttttttacctgc

SEQ ID NO: 1740 - DNA, 92 bp, Homo sapiens
gctaaatacctatctaatgtgctatgtttatcaaatcgtgtactaaaatggaaagctagttttgagaaattattcagaagccttgttatttt

SEQ ID NO: 1741 - DNA, 188 bp, Homo sapiens
tttcaattcttccaaaaggctcaaagatcccacgaagcatatcttcagttatgttgaagtgtaatgagcccacataaagcctcataggtccagcacttcccttttgtaaattgtttgccattgctgcagctctgtttttttctgcctgtgatgcctgtactatgattggcacgcctaaaactcgttgg

SEQ ID NO: 1742 - DNA, 285 bp, Homo sapiens
  misc_feature (1)...(285): n = A,T,C or G
ttnaaaatactttcaggctccaccaaaacgtagaactgaaagcatgtattttggaagaaagagatacattttgtatgctttcttttccttttgtagattcccagtttattttctaagactgcaaagatcactttgtcaccagccctgggacctgagaccaagggggtgtcttgtgggcagtgagggggtgaggagaggctggcatgaggttcagtcattccagtgagctccaaagaggggccacctgttctcaaaagcatgttggggaccaggaggtaaaactgg

SEQ ID NO: 1743 - DNA, 117 bp, Homo sapiens
  misc_feature (1)...(117): n = A,T,C or G
angatctatagacactttaggcaaaacaggctcataaagcaattaaaaaatcaacaatttagtaaaaacaggctacatagtattttgtttttacgtttcatttgtctattgatcttt

SEQ ID NO: 1744 - DNA, 111 bp, Homo sapiens
aaacaatgggctaaaaataaacagtattaaaaggttaagtttatataatacatatgtacacaattagtggtgttttcttttcagacaaaatactgaaacaaatattagttt

SEQ ID NO: 1745 - DNA, 305 bp, Homo sapiens
ctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgcgaccatcccgtaccggcccaagccgtccagctctccggtcatctttgcaggtggtcag

SEQ ID NO: 1746 - DNA, 319 bp, Homo sapiens
aaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaa

SEQ ID NO: 1747 - DNA, 177 bp, Homo sapiens
aaatccttttcccataaataaaagtacagttttcttggtggcagaatgaaaatcagcaacttctagcatatagactatataatcagattgacagcatatagaatatattatcagacaagatgaggaggtacaaaagttactattgctcataatgacttacaggctaaaattagtttt

SEQ ID NO: 1748 - DNA, 237 bp, Homo sapiens
  misc_feature (1)...(237): n = A,T,C or G
ctgaaggantgnaantagactggtngagagaggaaggcactgagccacatgaaggtatgtacgtaggttttgttcagtggaaatagactggtagagagaggaaggcactgaaccacatgaaggtatgtgtgtaggttttgttcagtggaaatagactggtagagagaggaangcattgaatcacatgaaggtacgtgtgtaggttttgttcactgacttcttcantgtctcagccag

SEQ ID NO: 1749 - DNA, 244 bp, Homo sapiens
  misc_feature (1)...(244): n = A,T,C or G
aaaaggccccattatctgacaaaatagatggtgaacatgcactatcccaggatatctattattatccaaagaagtgtttctcaaagngtggtccatggtactggtccatgaattggttgctaccagtcaatgaagagataaattacttgcatcagagtgtaaatcaatacattgctttagctattaataaaattttgctaaaaaatcaaatcctgtcattgacctaaaaagtatctctagattt

SEQ ID NO: 1750 - DNA, 289 bp, Homo sapiens
  misc_feature (1)...(289): n = A,T,C or G
aggccagcctccaccacgcacggcgaaaggagtgaactagctgggacacacacacgtgtgaatgcatgcaagcattcactgcatcttctccgtggactccctaccgctcttccatagccccccctttcagcctcactgtttctcgtgtgagcctatctgcttgggcagtccactcgggagggggtcatggagccaggactccctctaaataggaatggaaaggaccctgcagatatttttatcctanttgtgaaaacaaggtgcctctgattctctatatccatcacag

SEQ ID NO: 1751 - DNA, 594 bp, Homo sapiens
  misc_feature (1)...(594): n = A,T,C or G
ctggttattaatcacaagtcctggaaatggtctaatgaccgtgaatttgataaactcggcagagtctaagatccttctcatggagctgatttccaggtagctgggggctttgaaggacacccccgggggcatgccatcaaccaccacacagccagggttaattgtgattttcctgtagggaactttcacaggaaaacccataccaatagcttcaccaaatttccgactaaagaggtcattcacttgttctcttagctgtctagctttttcaactttcgagagtctttcattatcatcatctggaattgtcacctgaatgatgttaaggtcttcaacacctgatgcagtagtattaacattgggtgatgaatttatttttctgggagggctcttagaggaggtgctctccttaatcgccgtctcaaacatttcgggctttttaatgatgaacttaattttggctttgtttctgagtatcttctccagcctcggaatgccaaaagtcgatggtcttcggaatggcacaccctcaggtaagccttccacataaaagtcttncgggaaagactcaaataacgcgaacggcaccttcac

SEQ ID NO: 1752 - DNA, 311 bp, Homo sapiens
ctgaaggtttcatggctcccaaggcttggaccgtgctgacagaatactacaaatccttggagaaagcttaggctgttaacccagtcactccacctttgacacattactagtaacaagaggggaccacatagtctctgttggcatttctttgtggtgtctgtctggacatgcttcctaaaaacagaccattttccttaacttgcatcagttttggtctgccttatgagttctgttttgaacaagtgtaacacactgatggttttaatgtatcttttccacttattatagttatattcctacaatacaatttt

SEQ ID NO: 1753 - DNA, 587 bp, Homo sapiens
  misc_feature (1)...(587): n = A,T,C or G
ctgtccattatacaccgtcacgttgatccctgcctccagcaactcgtccacaatgctaatgactggcttcatgaagtcctcctccatgttcacaaagacgttggtagcctggcctccccaggattgatcctcaggaataattttgagcttctttctgatggggccattcatgagctggcttaaggcatctcgttgtaggtgtctcacgtggcgctgacaaagacaaactaggtggctctgtgtgaattctagactcgactccattgtagacgtgggagtgcttttagttaagatgttatagaagttcaccccatctgtgttctgttcaatgatcatttctgctttcccccacagctctgtggcctctctgtagagccccttatttacggcattcagtacttgctctgcaaccttagacacctctgccagacctttgtcttcgagaagagacatgctgtacaggtaaggtccccaggagagcaccgaatcaacaggggagatccaggaatcacccaaggcaacccccgcaaagttgcacttgatggtccctcnctgaatggncttataaagctctagaccaatgccag

SEQ ID NO: 1754 - DNA, 564 bp, Homo sapiens
  misc_feature (1)...(564): n = A,T,C or G
cctctctccttggcttgcaggtggcaccttctcactatgtcctcacatggccttttctctgtggagagggacagagagcatgagcaggctctggtgtctcctcttcttataaagacactaatatcaccatattagggcttaaacctatgacctcatttaaccttaaccccttaaaggtcccatctccaaaaacagtcacatagcaggctactgcttcaacatatgcatttgggggaggggacaccattcagttcttaacagggtggtcaccgcaaacatggaaagtcagagccttctccccttcagaattcccgcccccacccagggatggggaagaggagcagagaggtatgggaagcagacacggagagtggcaggtaccatgctggggtggctcaggagtgcttcngaggacatatggaactggcagggctcagtgcagggaggcggaggccctgggagagccgtgtcctgagaagggcctgggctacaaccctgggcaagttacttcacctctgagcctccgatgctctgtgaaatggaaggaatgtgcttgcctgtcag

SEQ ID NO: 1755 - DNA, 214 bp, Homo sapiens
aaatgtgatgttttgagcatcaaaaagctactatctaaaaggattagtctcccagtgttcttggtaaatggggaaggttaggaaggaggcaatgatccaatgaatatagaagaactggccgattcacaggaaacttgctttggataaggtgagtcaatgggtgatattgtgcaggcagggagggaaatttctttgtacaaattcatgtccctgg

SEQ ID NO: 1756 - DNA, 225 bp, Homo sapiens
  misc_feature (1)...(225): n = A,T,C or G
aaaattannacatacatggtcaggcagcttctgtccatanntaaactattccttttcagtctgagtaatatgcggnttgttcttaatnncncacattaanaatttatttagattggtgaaactatctttataaaaaaaaaatncgaacatgaatgcaaacttaccaaacagagcccactanattgatnaagttaatnccannatagtttgccatganctgggtgg

SEQ ID NO: 1757 - DNA, 282 bp, Homo sapiens
ttgcagcctgcgatgacacagcgaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcag

SEQ ID NO: 1758 - DNA, 473 bp, Homo sapiens
ctgaaacagcttttcaagctctctctcctcgtcaaggatcatgagaggcactccactcaaggggaggtgcgcaatctggtgctcttcaggcaggtcaaaactctcaaagtctagaggattgaagggaaagaatttttctatttctggataggcatcatctgaggcaggaacagagctttttgctttaacagtcttctcagtcatctttttggcagaaaagcttggctgtttttgtttgaggggtcccttggtctttacagacttttctgtagctctgttgacagttcccaaagcctttctagtagctttaggtaaggctggtggggcatcgaacgttttgccaaaacgtggtgttgaaacttgagatctcccatctaaggctttgattgaaggtccagaccccagcttcagcccatccttagcaaccacacgggtgcctggttctccattttccttatcgacatagatcagag

SEQ ID NO: 1759 - DNA, 187 bp, Homo sapiens
aaacttcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctggtgaaatagttgttttt

SEQ ID NO: 1760 - DNA, 564 bp, Homo sapiens
cctctctccttggcttgcaggtggcaccttctcactatgtcctcacacggccttttctctgtggagagggacagagagcatgagcaggctctggtgtctcctcttcttataaagacactaatatcaccatattagggcttaaacctatgacctcatttaaccttaaccccttaaaggtcccatctccaaaaacagtcacatagcaggctactgcttcaacatatgcatttgggggaggggacaccattcagttcttaacagggtggtcaccgcaaacatggaaagtcagagccttctccccttcagaattcccgcccccacccagggatggggaagaggagcagagaggtatgggaagcagacacggagagtggcaggtaccatgctggggtggctcaggagtgcttcggaggacatatggaactggcagggctcagtgcagggaggcggaggccctgggagagccgtgtcctgagaagggcctgggctacaaccctgggcaagttacttcacctctgagcctccgatgctctgtgaaatggaaggaatgtgcttgcctgtcag

SEQ ID NO: 1761 - DNA, 413 bp, Homo sapiens
ctgtcttctcatctatcttagcataggagtcctctgctgccttttcaataccgtcgtggtatttctccaaagcagttttcaagtttagaaatatttcctgggacttcagtttctccctttcagcagcatcttttagttgttgaattccaagtttaattttttggatttcttgattaattgtggttactcgttcatagacagcacctcttttttcttgaactttattgcaatcctcaattactgtgcgtttgtattgcttaacatcttcatgcttcttatttattttgaattgtgctgtggcaagtttttccttcttcacaatcatcagtcttttgaacgaattttcttcagtcttcaatttcttcagttctgactcatcactctcaatttggtcctccaagttcaggcttctg

SEQ ID NO: 1762 - DNA, 315 bp, Homo sapiens
ggaaaagaaagagctgaaaatgcagaaagccgaagagttagaacttttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcgttggggtggttgtcatgtgatgggtcccctccaggttactaaagggtgcatgtcccctgcttgaacactgaagggcaggtggtgggccatgg

SEQ ID NO: 1763 - DNA, 114 bp, Homo sapiens
  misc_feature (1)...(114): n = A,T,C or G
cgaccgcctaagagtngcgctgtaagaagcaacaacctctcctcttcgtctccgccatcagctcggcagtcgcgaagcagcaaccatgcgtgagtgcatctccatccacgttgg

SEQ ID NO: 1764 - DNA, 114 bp, Homo sapiens
  misc_feature (1)...(114): n = A,T,C or G
ctaatacgactcactatacggctcnagcggccntccgngccgggggctgctcnggttagatngacatgaanaccctacagntnccactgtggnaattgaaantatccctcatgt

SEQ ID NO: 1765 - DNA, 485 bp, Homo sapiens
aaacagtaacaaaacagaaagcaagaatcactgaacactgggtgcagtcagttctaagtccttataataattgccaaaattatttgaatgattcttcaagattaggctgatccctggctaaggtctgtgtaaggcagacaagcgttattgatcatatcaagttccctacaatatcctgtcctcaaaaccggaagcaatgaacatgatcctcttcggttggataaatgaacttcctgtttggcctgcttctaggccctgccagattctcataacatcatatacgtaagtatagttcctcaaagtgactgacatttattttaattttgctttgtttttttttattttctcccccattcctttattttgtgttattcctgactcacttgacactctctgatgcctgagagattcctgtttgggatttaatatccagggctgtgtttacagtaaaaaaagcaggcagtcccttttagtttttccttttt

SEQ ID NO: 1766 - DNA, 389 bp, Homo sapiens
aaaaacaaagtcttcaacttgggtgttgagattggcaaaaggggaagcaagggaaaagccaaggaaagataaaatattcagaagaaagtcaaagttatctgcaattacatgttagaacagattttgcaggttaaaaagatgttgcttaaatatattcataaacctgttgtaagattttcacttatgcagtttcagaaaatttagctgcttaacatatgacagaactgtattttaacaaatgacattaaaagtcaggagagctactcagttaattgataaagtagaggcaacgtgggggagccctccccacgtttattgaagatttgtggctcccccagccccgtttgcctgcatcaggctaacaacctcattcctcccatagagcctgg

SEQ ID NO: 1767 - DNA, 176 bp, Homo sapiens
  misc_feature (1)...(176): n = A,T,C or G
tttttcaacgattaanaatnntcattacataactnggtgaaactgaaaaagtatatcatatgggtacacaaggctatttgccagcgtatattaatattttagaaaatattccttttgtnatactnaatatcancatagagcnagaatcatattatcatacttatnatantgttcan

SEQ ID NO: 1768 - DNA, 384 bp, Homo sapiens
aaaagaaatcatggtacttcttagagcaatttgcaaaaggggaaaaaagtcttaggctcactccttggaaataaatatcaagtaaccataaaaatattcagccatttttcagttattcggggagttcaggcatggtcccacgcagagcatcagagttcctctttgaaataacccagctttgccaatgacatctcttttctcaactgcataacctcccaaaacatctgatcaacatcctgctgtttcacaagtccctgctgaatgtatcgaatgtatgtaaaaaagttacatacagaagtgatcctgtatctgcaaaaaggagaaatacaataatagttgcttgagtcccctaatttaattctgtgtttacaggacttactctgg

SEQ ID NO: 1769 - DNA, 111 bp, Homo sapiens
  misc_feature (1)...(111): n = A,T,C or G
aaatataaaaaattaaaagttaaaactctagcccttcagtgaaggagacgtaaaatggcgtgggtaacaacaactaccaaaaaaaaaaaanaaaaaaaaaaaaaaaaaaaa

SEQ ID NO: 1770 - DNA, 225 bp, Homo sapiens
ctggctgaaggggccgtggagctcccgccagcccacgattagctgggccttcttcgggccaatgcgctgaagactgcggagatctcgggctgagccttcgttcagcagatccagtattttttggcgcccatgagccagtagctccgggctgatctgtagctcccagcagtcctcagccttctcctcaggctctagggcatccagggactccagctttctcttccg

SEQ ID NO: 1771 - DNA, 223 bp, Homo sapiens
  misc_feature (1)...(223): n = A,T,C or G
ggccaagtaaaagctttatttttttaaatgaaaactacnaaaggcggggtgggttgtggcgggggcaagttgtggccctgtaggaccttcggtgactgatgatctaagtttccggaggtttctcagagcctctctggttctttcaatcggggatgtctgagggaccttccgcggcatctatgcgggcatggttactgcctctggtgccccccgcagccgcgcg

SEQ ID NO: 1772 - DNA, 419 bp, Homo sapiens
ccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggacttt

SEQ ID NO: 1773 - DNA, 172 bp, Homo sapiens
  misc_feature (1)...(172): n = A,T,C or G
cgngcggctgcggggggcaccagaggcagtataccatgcccncatagatgccgcggaaggtccctnanacatccccnattgaaanaaccattagaggctctganaaacctacggaaacttagatcatcaggtcaccgaanagtcctacagggccacaacatgccccctgcac

SEQ ID NO: 1774 - DNA, 525 bp, Homo sapiens
ccttcactctcccctgaggctgtcctggcccggactgtggggagcacctccaccccccggagcaggtgcacacccaggtaagcaggtccaggggctggggtgggcagggctagcttttggatcctgagtgtcactactctctcctcccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaacatggcccttcctggtccctttattgatgtcatccagggtcttaacgcccctgaggctgagccctgctgcagaacccacgctcctggccttgggccagcag

SEQ ID NO: 1775 - DNA, 458 bp, Homo sapiens
aaattttctagtcaaattaataagcctttgtattatatgccatcctcctttggaatgatagcggtataattaaaatagaacatttttaacacagaatacttattggtgaagtggtctcttatgtagtcttcttttgacgagaacgttgagattttcgaactttcagaactttctttttttgatgttttttcccattcttttgctttttcttttggctgacctgtttctcccactttttaatcagttccttcacatctgctgaatctgggtttagacatgtttgaactccattcttcagtgtagcaatgatttcaattttctcgcaggaagggcttggggcaaattgtttaaggtctttcaaggattgtaggtggatagtcccttggttggtgctgatgcaggaacagcgaccctttctcactactggggttccttgcactccaatcagaaccagcaag

SEQ ID NO: 1776 - DNA, 461 bp, Homo sapiens
aaagtttcacttccctagcaaaatatcttcagtcaagaaattagtctttgaaaattatgaaaattgttgtgggaaatatttatacaaattattactgataatgcacatatattttgaaacattgtttctagaagcaataaaatataacctatttaggagataacccaaatgatttgtaaaaaaattaacttgtagaaaagggaaggatgttgtgtaaaatcaagtcaattatttgaggtttttataatattgagtacttatgtactaagtcacacccagccagtcaataactgagaaatcaaaataaaataataatttcaaagaattacataaatacagggccttttgagatttttggcaattgtaaacaaaaacgaatggtttttacaattcagtgtaattctacgaatatttatttggcacccatgttaggcactgaggctacacagcagtgaaatagg

SEQ ID NO: 1777 - DNA, 368 bp, Homo sapiens
ccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattgaaagaaaaaa

SEQ ID NO: 1778 - DNA, 554 bp, Homo sapiens
  misc_feature (1)...(554): n = A,T,C or G
cagttatgcgaaaacatggctgcggccggtttggcccttctttgtaggagagtttcatccgccctgaaatcttcccgatcgttaataactcctcaggtccctgcctgcacagggttttttcttagtttgttgcctaagagtacaccaaatgtgacatcctttcaccaatatagattacttcataccacattgtcaaggaaaggactagaanaattttttgatgacccaaaaaactgggggcaagaaaaagtaaaatctggagcagcatggacctgtcagcaactaaggaacaaaagtaatgaagatttacacaaactttggtatgtcttactgaaagaaagaaacatgcttctaaccctagagcaggaggccaagcggcagagattgccaatgccaagtccagagcggttagatanggtagtagattccatggatgcattagataaagtggtccagggaaagagaagatgccctaaggcttcttcagactggtcaaganagagctagacctggtgctntggagaaagaagacatctttggaaagaatcatctgg

SEQ ID NO: 1779 - DNA, 379 bp, Homo sapiens
  misc_feature (1)...(379): n = A,T,C or G
gtcttggctgggcatgacaaccgcgtcagctgcctgggcgtnactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgagaccaagagcacaattcccattgagagaaagatctctgtgctgtaaactaaaacaaattgtgcattccttccggggccatcgtctttgtcttcttttttgtcttgaatgaattnt

SEQ ID NO: 1780 - DNA, 222 bp, Homo sapiens
ctggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatctttt

SEQ ID NO: 1781 - DNA, 292 bp, Homo sapiens
ctgctggagcaagccctgcggaagcacaacgtggctgagccgtgttccatcaaagtccttgacaaggctacggtaccaataataaagctcacagatcaggagactgaagtgaaagttgacatcagctttaacatggagacgggcgtccgggcagcggagttcatcaagaattacatgaagaaatattcattgctgccttacttgattttagtattgaaacagttccttctgcagagggacctgaatgaagtttttacaggtggaattagctcatacagcctaattttaatgg

SEQ ID NO: 1782 - DNA, 381 bp, Homo sapiens
  misc_feature (1)...(381): n = A,T,C or G
aaaacctggacctttctggaagggcagcatataaaaacatcagtcccgaggaggggacaacaatactacctcactactacatctgtgatgactggttgttcaaacacaatggagtgtgtaaggtatatgttntataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgcac

SEQ ID NO: 1783 - DNA, 127 bp, Homo sapiens
aaatatctatgtcacagcaaacaggtggcaattcaacatccagggtcgacagaatgcttgaaggagactgcaacagattggattcccatggtggagagggcatcttcacaggtgaaggggggcccag

SEQ ID NO: 1784 - DNA, 259 bp, Homo sapiens
agcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaacctttttt

SEQ ID NO: 1785 - DNA, 400 bp, Homo sapiens
ctggtacttgacagagaggatggcgctgtcgaccatagtctcccagaggaagcagataaagcggaaggctccccgtggctttctaaagcgagtcttcaagcgaaagaagcctcaacttcgtctggagaaaagtggtgacttattggtccatctgaactgtttactgtttgttcatcgattagcagaagagtccaggacaaacgcttgtgcgagtaaatgtagagtcattaacaaggagcatgtactggccgcagcaaaggtaattctaaagaagagcagaggttagaagtcaaagaacatattcttgaaagttatgatgcattcttttgggtggtaacagatcataaagacattttttacacatcagttaatatgggattattaaatattggctataaaa

SEQ ID NO: 1786 - DNA, 372 bp, Homo sapiens
  misc_feature (1)...(372): n = A,T,C or G
aaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttatagttttcagtaacttaaaaagctaacatgagagcatgccaaaatttgctaagtcttacaaagatcaagggctgtccgcaacagggaanaacagttttgaaaatttatgaactatcttatttttaggtaggttttgaaagctttttgtctaagtgaattcttatgccttggtcagagtaataactgaaggagttgcttatcttggctttcgagtctgagttt

SEQ ID NO: 1787 - DNA, 86 bp, Homo sapiens
  misc_feature (1)...(86): n = A,T,C or G
atgatgattactttcacatcgnaatccaacctgaagagtactttgttctccaatgttgctgtcaacattcagccatttatccttat

SEQ ID NO: 1788 - DNA, 354 bp, Homo sapiens
ccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagttttt

SEQ ID NO: 1789 - DNA, 651 bp, Homo sapiens
taaagggcttcttgcttttttgaatacaaaacatgatctattgtaataaaaaggtaagacattgattttacaaaattatatttccaaatacagataaaaaaatcttgaacagttaattcagattttattgatctaaaatgtgcaaaatatctgataatacttaagtttattaaattcattgtacataggctgatatcatcccatacaaaaaaatgctcagtatcttgttaagattcaaaatagtgtttaattatctgagcttaagatttattgaactactatccaaataacaacaaaagtccatattgtaaaagaaaaaagtaaaactaaaaattttctgattattaattgacttgaaattcattcccattaaaacataaaactatagccaatatccatttgaaaagtgaagaaaaactggaagtccccatgataaatacaccaattccaaataaaaaattaaaatcaaattttgctattcaaaacacacatgatcttttaagttattcaggtttaatagatttactaaggatagagttcatagagcatgtatttggtacttctgtttagactcaggttttgcaaagtccccaagagaaggtgagaaggtaaaataaacataaaattgggatccttctctcccaccacacc

SEQ ID NO: 1790 - DNA, 388 bp, Homo sapiens
aaatcatgtttaacacagtgtacacaagtcagtccaacagttagtgttaattactaataatatatgaaaaccctgccaacacaattgctgctacatcaccaatataattattaaccactgtcggaaaaacacacataaattcaggtaagactaaaagctgtctcacaaaaagaaaaaagaaatccaatggatccactaatgctatcaaaagggacatgcaggaatgtaacatgacatttttagaaatgtgtgtttctaaaaagaaaaaaaaatacactaaaatgccagtggactataattcattcaaaacatctttagtgttccttcccaaagatcttgatctgctcagtaattgcttcacaagatctatcacagccatcttttggag

SEQ ID NO: 1791 - DNA, 2442 bp, Homo sapiens
cgggagcttgaaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacttgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgtcccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaacctttgtagcttttagctgattaattagaaaaattaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataataagataataagaaaagcaataattttctaaagctgtgctgtcggtgatacagagatgatactcaaattataataaaactcttcattttgtgaattatagaagctactttttataaagccatatttttttagggaaactaaggagtgacatagaactgatgaatgagtaaaagtaagttttgctggatttttgtagaactctggacgttgaggattcattatgctgtggttaactttaaatattttt

SEQ ID NO: 1792 - DNA, 2279 bp, Homo sapiens
cccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaattacccattctgtttccacaagcaatgtaattggatttactaagcatgtttatgttcagcgcctaaactctactggtgggcgctctcagtactcctggtttcaatctgtacgtcattctgctttccgagctagtttttcagagatactagaaggaaatactgatttttcaaatttcaaaaaagttctttccaagtcatctttgacatttgtgaagaattaggagatttgccaaccactaatggaaacaagcctcatgaagtttaatggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgttaaaaaaaaaaaa

SEQ ID NO: 1793 - DNA, 1904 bp, Homo sapiens
gggaatttgaattggaatttacttccagctgcactcatgcaagaatttgtgatgtatactaaaaaataaaaaaaggctcattcaggagagccttgtactcagcaagagtggctaacattagagcatacagactatgtgattgtataaggcatggagagttaaacaacctccagtcagctgcctgtttgaataccactgacttgttaagaatgatcttgcttttagattttaccatattcaaacttattaggtgagccttatatagcatatatacctggctgctattgtggggtttgggaacatgaggggtggggtgaactgttgttgttttaggtttcagtcagacagacatccctgtgcctcagttcccagaagcacagcaggcctctaggagcatccgtgggaacggcgcagtcctgacatcaccaactctcctgctcaggctcatcccatatacagaggtcaaagggtggggtttgatatcgggggaaggaatgagaaagtagaagcaatgtcacttcagtgccactgttgactagtctttggtgcttatgtcagtatttgttttatttcctgatttttttaaagttggcaaaactacatatttttatcttgatgaaggcagtgggagggtggaacaaaaacaagccattactgctatttctagttcatttactggagactgtcccttaatagctaatgtagaataaatttgaaacatagacctagatgacaaaaagaatgggaatagaaatgaatctcaggatttgaacaaacagaagacgtttatgctgtgttgatgcccagttctacaactgctattacatttgtcattctgtctccccttttcccctaattcttttatgtatgtatgtatacagtttgaggaaatgtgcatctatggtcagtcctttttaaaagacttaatgaatttattactcttttgcaaaaaatatacccactgcttatatgggcatacaaatgctaccctattttaaatgtaggtggcgtatgtgttcgtgttttaatgtattcagagccattgggcaataagcagtccagaacattgaaaactcaagcaggtaaagcacctaacacccttagtttctagaattactttaaaaaacttttatattgctgcatcttccacagttctttgggtagtctctgaacttaaaatttgtaggagttgtagactacctaaatttttaagttatggtatttgttcataggttgtaggggtaggtaaagaaggaaacagacaagaaaatggcttcttgaggtggcagctgctgagtggctaaatcttaccactttctttctactttttttggaaattttcccagcttagcatgaacatggatcatacagtgtttgattttatgtgattgagatttttgttttttatttttggagggaaggtcttggagaaacattaaaaagttggtgtatgtgcaaaaatacgaaatgttaaacaaaggaattttttcttatttaatctgaatggtaagcaagaactttttctatatacccttctgctgcagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatggttcttttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgctggaaataaaaaaaaaaaaaaaaa

SEQ ID NO: 1794 - DNA, 2881 bp, Homo sapiens
acagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaagcctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcaggtttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttccgagtttccccagaagagaatatgggattttttttgacatttttgacccatttaataatgctcttgtgtttacctagtatatgtagactttgtcttatgtgtcaaaagtcctaggaaagtggttgatgtttcttatagcaattaaaaattatttttgaactga

SEQ ID NO: 1795 - DNA, 422 bp, Homo sapiens
  misc_feature (1)...(422): n = A,T,C or G
gttttaaagcctctggacagagcagtatttcgtttaaaactttgtttttcttaaaagcttacagtgtttggctaattctcctcccctttttacaagacgggggccggagggtggacactggtggcaggttaagggatactgtcactttaagaagcctgcagattgaagtgtaaacatggagaaattaggggctgattttttaaactgtgtgagatattaaccagccgccctgttataaaatcaggaaatccaaacagcgatttacaccgattaacaccccctttatatatttttnacaaaaatacactgagaaaataatcaaacgttttcatctctcttgtctttttttgttttttaaaagtgtcaaaagtctacatntaaatataaaanattaaaagttaaactctagcccttcagtgagg

SEQ ID NO: 1796 - DNA, 797 bp, Homo sapiens
agtctctgctcttcccagcctctccggcgcgctccaagggcttcccgtcgggaccatgcgcggcagtgagctcccgctggtcctgctggcgctggtcctctgcctagcgccccgggggcgagcggtcccgctgcctgcgggcggagggaccgtgctgaccaagatgtacccgcgcggcaaccactgggcggtggggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccttgggcaatcagcagccttcgtgggattcagaggatagcagcaacttcaaagatgtaggttcaaaaggcaaagttggtagactctctgctccaggttctcaacgtgaaggaaggaacccccagctgaaccagcaatgataatgatggcctctctcaaaagagaaaaacaaaacccctaagagactgagttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacat

SEQ ID NO: 1797 - DNA, 4600 bp, Homo sapiens
aatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttcttttttttttctttttttttttttttttttggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaaccctaaatcttgacttttgtcgttattatgcccaatgcctaagattggaaaggccctacagtatctggacactacacaatctgccttagc

SEQ ID NO: 1798 - DNA, 1635 bp, Homo sapiens
cccgagacccggcgcaagagagcgcagccttagtaggagaggaacgcgagacgcggcagagcgcgttcagcactgacttttgctgctgcttctgcttttttttttcttagaaacaagaaggcgccagcggcagcctcacacgcgagcgccacgcgaggctcccgaagccaacccgcgaagggaggaggggagggaggaggaggcggcgtgcagggaggagaaaaagcattttcaccttttttgctcccactctaagaagtctcccggggattttgtatatattttttaacttccgtcagggctcccgcttcatatttccttttctttccctctctgttcctgcacccaagttctctctgtgtccccctcgcgggccccgcacctcgcgtcccggatcgctctgattccgcgactccttggccgccgctgcgcatggaaagctctgccaagatggagagcggcggcgccggccagcagccccagccgcagccccagcagcccttcctgccgcccgcagcctgtttctttgccacggccgcagccgcggcggccgcagccgccgcagcggcagcgcagagcgcgcagcagcagcagcagcagcagcagcagcagcagcagcagcaggcgccgcagctgagaccggcggccgacggccagccctcagggggcggtcacaagtcagcgcccaagcaagtcaagcgacagcgctcgtcttcgcccgaactgatgcgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacgacccgctcagccccgaggagcaggagcttctcgacttcaccaactggttctgaggggctcggcctggtcaggccctggtgcgaatggactttggaagcagggtgatcgcacaacctgcatctttagtgctttcttgtcagtggcgttgggagggggagaaaaggaaaagaaaaaaaaagaagaagaagaagaaaagagaagaagaaaaaaacgaaaacagtcaaccaaccccatcgccaactaagcgaggcatgcctgagagacatggctttcagaaaacgggaagcgctcagaacagtatctttgcactccaatcattcacggagatatgaagagcaactgggacctgagtcaatgcgcaaaatgcagcttgtgtgcaaaagcagtgggctcctggcagaagggagcagcacacgcgttatagtaactcccatcacctctaacacgcacagctgaaagttcttgctcgggtcccttcacctccccgccctttcttagagtgcagttcttagccctctagaaacgagttggtgtctttc

SEQ ID NO: 1799 - DNA, 2036 bp, Homo sapiens
tttcctctttctctaagagtctctctctccctttccctctctctccccccaatctgtctttctagcatgttgccctttttcaaccacatttgtgtttcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtccccccccccacctttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaactgtctg

SEQ ID NO: 1800 - DNA, 2842 bp, Homo sapiens
gtgggcatccacgggcgccgagcctccgtccgtgtctctatccctcccgggcctttgtcagcgcgcccgctgggagcggggccgagagcgccggttccagtcagacagccccgcaggtcagcggccgggccgagggcgccagagggggccatgtcgtaccagggcaagaagagcatcccgcacatcacgagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgaccgtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagatgtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaaagaaaatgaactgccc

SEQ ID NO: 1801 - DNA, 4086 bp, Homo sapiens
aaaatagcgggtactgtggtaccggaggctggcggtaccagtgtggattccaagtgatcatcacaggtacatatagtgatcttccttgtccgtctcgtcccactgggtaccaggcgaatcctactgggtaggtcgggtacgcggcatatgtggggtatgtttggtatccaggtatttgaggtacgaattcagtgtacgttgccaggtgtgcttggtcttctaaatttggaatacataggcgaggatactgattctggatagtaaaattgtttggagctcggcaatcataagaaacttgcagtttccaccccctcttcacctggagaacttgggctccattaggtgcaatcgttggagtaattagcccatcttttacatttcttgccacaaaatctcgaagagctgccatttcaggttcggacagtgaatacacatgtccactgggaatactgtgtgctccaggtatcatttctatgtgagggtcaaccaggcggtgatctgggtagacgtgctcatctactggagtgtacacattctggacatagtaatacctcactggttggtaaactctgtatccatctactggataatagagtggcggttgtggtgctggtggtgggagcgatggtggtattggagaatacatccggcagtggtagcggcagtattcagaatcaaagacgatagatcgagtgctccatgtgatattgggatcatgtgtgctcagccagcgaacccctaggacgacagggaagaatggagactgagtcacatcaaatgacagcacctctcggtgatctcccaggtcaactatcaggtcgtgagtttcgtggacaactgggcccgatgctatggggcgcccatcaattgcttccacaagtattggccagtccttgattcttagaggaattccattttgagcaacatattcgtgatcaatgaagttgccagaagcaccagaatcgatcatggctcggacgaacagggtgtgtctgcccggaagatgaatctggagcatcacttgcaagtgtggagatgaggcatcatcttgtggggaccttattatttctggcccggtcgctgaaggtccctctacagcggggccggggagtttcccgccggcgaagactttgaggccttggcaggacaattgtcagcgtagtgacctcctgttccacagtagaggcacaggttcagctttctgcgtctttctttttcttcctgcgtcaggcgcatgcgggcacctcccaccggctcggttggatctacctggtggtggcttgcaatgtgaggcaacaccagcgcccggggtggcgagcgtggcttgcgagctgcagcagccctggccagccttctctcaatgtgaatgcactgcccaatcagagcagacagcgacttggcgacctcgagcaacattaactgaggaaaaaattgaaaaaggggcgcccttgcttgggggcttcctattgtggaactgttatggaaaggagccccatccattgcttcctccttgaatggcaaatgcctttatgatccctataacttgtcccattatgtttagacccttggtggtcagaagggttctatttagggcagtgtcccctgcccctccttgtcctccaaaaattttgggaggcactgacgtggatgtcatggggtcagcacaggcatcaacatccccagagggatggaaccaagcagcctattgcccaggcattcactaacaggcagcccatcctcagcctcatagctggccggggagaagaaaggctattttgggtcccagatctttttttttttttttgagacagagtctcgctctgtcacccaggctgaagtgcaatggtgcggtctcagctcactacaacctccgcctcccgagttcaagagattctcctgcctcagcctcctgagtagctgggactacaggtgcgtaccaccaagcctggctaatttttgtgcttttagtagggacgtggtttcaccatgttgcccaggttggtctcaaactcctgggctcatgcagtccgcctacctcagcctcccaaagtgctgggattacaggcatgagccactgcacccggtctctgtttacaaatttatcaccagcttcatcccctaaggttataagctccatgagggtgggaagtctgtattgttcacctctgtatcctaagcatctagaacatagcccggcacacagtaggtgctgaagaattgaatctgttaatgtagaaaggatgtttcatctagctgaagtgtcttgtacagaataaactctcaataaatgaactgtggacacatggaagggtgagctagagctctgctcaggggttgagtgctcctcttgtgcccttgtggttgtctggttacctgaactaattggagtgcgatgcagacatagtcatggagtgagacagcagaactttgctgtcttgtttgtgagcccacatcaggggttctagactggctggttgacatggtggccccagcctgtctcttcagcagctcggcttataaaaaataaccacctcctattttggcctctttggccgaattcggccaaagaggcctagcctccgattactaaaccccttgccccacaaacgtccacattgacgagcctctttttagtaactgcttccccgtaattccttcagaggttgctgtacccttcgctgatgtgctgccctcctgtaaaacctccagatgccttcccacgtaatgcccctttcagatgctttaagctgagagcttaaaccacaggtaccatggctgacgcctgccaggtttctgctgcagataatctatgatgggaggggcatattttttacttcattacttatgtaaactcttgttccagaaagctttaatgtgtgtgggagtgttctgggtctattaggtctgtgcgcatgggtgtgggcatttgcctgtgtccaccgggtgggtctcattatgaaatgtatgtttatgtagggctttaatggctgaaaatggcaaagagatgaatagaccacttggccccatgtgtaattgccaggccccttctgtgctcaaatgaggtgtccgagtgaaggtcagcccttcccttctgtatttggggcctatttatgccaccagtaattttataagaaatctgaatagttctcccctttgagtgcatttaactctttagtatcttctctcttacctatttgagcccctctagctacagtctggcttaaatgaaaggggaattatatgcttaagaaaaagtaggacacggttgaggcagtttgctgactgaatacgcgaagaaggacctgatgggctcatatgcaccactgccatcacagtccccatcgtgatgcaagcttatatgattcttgaggtaactctaccagatacttccagatttagaaatgtgtcaaaggaaaaattggtgatactcttctttccctgccagaaacagcccagatctcctcttaagcggaaaagagattgaccttctagcagaggcaaaggtaaactcctgtaagttacttctgttaccaaagggaggggggcggcttttgtgaatgtatgaggagcttttgccagagagatattcggaggaggggtgtgcccatatgcacacatatattttcccgcataaccgtatccaatgctagcatttagaggaaggcatttagccaccaaaagtccatccatctatgctgcttccacagagaaaacattttctctttcctcctcttgaacttacataatatcctcctcccattccaaccttagaatggagtcttctgggggcagctgcaaagcgttctccctaggacagatggagcctccctttcctcatctactctgtgggtggtttcagggcccacgagtcaacatgaggagttgtgctggtggtatgtgtgttggaggctgggctggctgattcacagtgacgaggatgtcaataataacaagaatgagaatgatggtacctaataaagactttttttcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1802 - DNA, 2512 bp, Homo sapiens
gcggggcctctaccggcccgatggagcgcgcgggcgctactagccgcgggggccaagcccctggcttcttactgcggcttcatactgagggccgagccgaggcggcgcgggtgcaggagcaggacttacggcagtgggggctgacagggattcacctacgctcttaccagctggagggagtaaactggctcgcccagcgcttccattgtcagaatggctgtatcctgggagatgagatgggcctggggaagacctgccagactattgctctcttcatttatttggcaggaagattaaatgatgaagggccatttctgattctttgtcccttgtctgttttgagcaactggaaagaagaaatgcagagatttgctccaggtctttcctgtgtaacatatgcaggcgacaaggaggaaagagcctgccttcagcaagacctgaaacaggagtcacgttttcatgtgctactgactacctatgagatttgcttgaaagatgcatcatttctaaaatcattcccttggagtgttcttgttgtggatgaagctcacaggttgaaaaaccaaagctccctgctgcataagaccttgtcagagttctcagtagtcttcagtctcctgttgaccggaactcccatccagaacagcctccaagagctctactccctcctcagttttgtggagcctgatctcttttccaaggaagaggtgggagattttattcaacgctaccaggatattgagaaagaatctgagtcagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaggttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaaggtggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagc

SEQ ID NO: 1803 - DNA, 1014 bp, Homo sapiens
gcagaaatagcctagggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtgtgcagagaattcaccgagcgtgagcaaggagaagtccgcttctctgccgtggctctctgcaaggcagcctaatgctctgtgggagggactttgctgatttcccctcttcccttcaacatgaaaatatataccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggttatgttgtcctaaagaataaattttgctgatagtagc

SEQ ID NO: 1804 - DNA, 17569 bp, Homo sapiens
ggatcccttgtaaccccatgatgcatgtttatcttcgtactttttatttttgttgttgtttttttcagatggagtttaagcccagctggagtgcgatggtgcaatcccaactcactgcaacctctgcctcccaggttcaagctatttttcctggcttagcctccggagtagctggaattacagatgtgcgcccccatgaccagctaattttttctatttttagtagaaatagggtttcaccatgttagccaggctggtctcgaactcctgacctcaggtgatccgcctgcctcggctcccaaaatctcttgttatttaaagattatctctttgtctggcttttagagttggatgataacacatataggtctgagtctctttgactttatgctatatgcagttctttaagttacttgaatttgtagatttttgtctttaaccaatttgaaaaatttgaatgattttattctccaaataatttctctactaccatgggtttgcacttccccttctgggaatccaatactatcatactggttggcttgaggtgtcccataagtcccttaggacctgttcacatttctttattcttgcttcatgtccttagactcaggaatttcaagtgtgctatccctatgtgtattgattatatcttcatcctgctcaaatttgctattgaaacactctctggtgagttttcattcaggtatatttttagctccaattgttcctttcttttataatttggtaattaatacctatattgtgatttctattttcagatttctgtagttcttaatccatattttcattagcaattttagcatatttaagacagctgtttaaatgcttctctactaatgcctgtgattcttcaggaatgattctacgatatttatttctcctcataatggactgtgaatttctgttcttggtaatgcccttgtcatttatttttgagctgagtcttgctctgtcaccagaatggagtgcaagtggtgccatctcggctcactgcaacctctgcctcctggggtcaagcgattcctctgctttagcctaccgagtagctgggactacaggtgctcaccaccacgtccatctattttttttttggattttagtagagacggggtttcaccatgttggccaggatggtctccatctcctaacctcgtgatctgctcaccttggcctctgggaagtgcgtgggattacaggtgtgaaccaccgtgcctcggcctgtgtatgccttgttattttatttaactgggcatttgaaaaaataaacatcttttttactgtatatagatttgttctatgtcatgacagtcattaacttatatgtgcgcgagttctcatcaagacatcagccctacgtaaaactcaagtccttctagttgtttctgaacatgtacctatgtggactgtgttgccctttatatttccccaaataaccaatggcttttgaattgcttactattatgaaattttgcatcccagttctcctcaatagcttagatggactattgcatgtctctcccctggcctttgcctataacatctgtatgtgtatagtcaccctgaatctctactgagccactccagaaataaataagtttatttcagtcaattttaggtattttctgatgtttccatgagttatatgggaatcttagaatccaccatcttgttgaaattactctgtgaaaaaaattttcaatatctttataatattacatttatgtcaatgataacaatttacctatttttcaatttctgtttgttttatgaaaaaggaaatagaagcaatcagggcactgcaagttgtgcctactccaagatgtgaatcatggatcatgcaaattacaatcatgttttaacctgacctccaaagggagaataaagtaaaaattatcccatgtgaggattattcaccagtttatatgtcattagttaccagttttcctttatgaataatgtttagcaatattataaagtatatctaatagttatcaggttttttggctcgttactttttggtagtaacttataaaactgactggaaaagaccaataaggcactgtttgcatgttacaaattatatccaaagaccaaaagctgttaataagaaatcttccaataaaaccacatcatattttcttttttatttacacccacatcaggattacaactttatcaggactgcaccttgatcaggaaggcctgtttctcttacaaggctaataagaaaggaacaataaatttgctgatgaaaaaaagtcatgtatttaaaaattttaactttaatttttaattgagggcaatattttaaagaaatgctcattagtcattcctttaaattgtgtgtgtgagagagagaaaatgaaatagtcattcaatgctgcagatgcagaggactcatcatcatggcacaacaaaagagctgtgcactagagttctatatctatgtaagtcacaatttgttctacaaatctctttgagtaatttatgtctcatatatagagatctggaatagcaaaaatacttcagaggaaattaatgagtgtatcatgaccacataataatttacttatgaattttcttaggtaagaaacggttgaactggatgcaatttttatcacagcttgtgtaagactgcctctgtccctcctctcacatgccattggttaaccagcagacagtgtgctcaggggcgttgcagctcattgctcttatagcctgtgagggcacggaagaaacatttgctaaccaggccagtgacagaaatggattcgaaataccagtgtgtgaagctgaatgatggtcacttcatgcctgtcctgggatttggcacctatgcgcctgcagaggtaacaattaatattttagtgttgagagttcaaaggagctagagtaagtggaagctgaccaggttgtcaggcttgtgttccatgttactctgcatgactccctttaaacgtcagtctttgtctgcaatgccgtcttgtcacagggtcatctactgctattgtgcactgtttgtcttctgtatgttatttcacagcttgtcagagtctataaaactcagcagaaagaacacggcttgcctgctccctctcttgaagattgattgtaatgggagtggtttctctgtttctttgtatagtcgaacagatatttacgtcttccaagaagatacaattcagaggaatttttatggcaaaagttagtggagacaggtggatgaaatctgtgaggagagtatcactgttctgatgggcggccgtttgagccacccacactgtaatactagacctgcctaaagagaattttcccatgtactattctcacctctgggaaaattaccctgaatataaatatgtccctcattttaagaaaaaaaaaactagaaccaaacaaggaaagtttaaattctttgtctttgttaatatggggtcagatttgtataaaatattgtaacagaaaaatttcttgttctctgacaagaaaattaatggaatatattttattttctagatttagaaatagctaaatactatttctatcactggaagaaaacttgtatctcaagactgtcttgggaatacaatgtgtgtgaataggaactagttatataaaatttgagtctcacatttctcatctataagatataaggagttacaaagggacattttgaagaccattgacaggagtggtttattttgtaatataaattggcatggagaggaagtaaagatgaggataccactgaagctccggccttggtaagcctttgattgcttgcacagcgaagagaagatcaaagatggtatgaggagagggctgtgagacccggtatctagttccttgtaatttcacaggggggagcctctggaatactttcaaggtgggaagatagtttgctttgtttctgtttttgtcatttaaaagatatactgtcaaatctgtatccaaatttgttacataagtcaatcaattgtaaattttactgcaatcatatgtttcctgacagagttgccttgaatttatggagctgaacccattttgctaattcacttactcctgcagcctatttcttagatacacaaatcaatatccttagagtatacatctttacacctagtatgtggttgtgttatgcagacagaatggccaaaacctgggtagaaaagatctaacataatagactgctatccatagatgtgcctatttccaatataaacctgctggcatctgagaaagtggagttctccctgtttcctaactgataagaatggtggctctagctaactgtttgtgtaaactgtggggtttctgtgcacctgctttgcttttggagactggaagatttgtgtctgctaggcagagtgagtcaatgtatccagtcccagacaaaatcttagcaatggagtatgtagagggcatctcttgtagacaacagttcacatacattgacaaaatatgatgctggataaagtcagtgcgctctgtgcaacatggtgggagaggaatcacaggagcttacactgcattccttcataattccttccatgtggctatttccttgtgttaatttcaccatactaaaaataattaagattatgtctgttaactatagttgcgtcctgttgatttttccaaaaaatcactgaaagtgaaattattttggggacacttccaagctagtggtcaagcagtgatttttctgggactgcagaagttcctgctatgcccaacctttattactaaatgggaaagacccagtcagactgggatgggcttatgattctacatacagagctcatccaagaaaggaggaaaagctgatttttgtgaacgttgctgcttgtgcccgaactaactctcaggcacattagtcagaaaatattacgtttggttgctccccgaggttcctaaaagtaaagctctagaggccgtcaaattggcaatagaagccgggtaccaccatattgattctgcacatgtttacaataatgaggagcaggttggactggccatccgaagcaagattgcagatggcagtgtgaagagagaagacatattctacacttcaaaggtactgtgcctatgagcttgtgtgcacatgtatttattccddgtgattgtgtggaggtggcagttctatgactggatcagggtgaattgtgcttatttattacgatttattcacacttactcatgtattaaaactaatatcaaaggcaggaagtgaagatggctttctcatctttgcagtgttccaattcatgccttcaaagatgcctttactctttgagctcagcacagatcaatatggtttaacatagactatagaatgagagataatcttaatcatattatgttatctgttacctcctgggtgagtttcttacatttgttatgattttgagtttccattgtcattttgatcagagagagagagaagcgatataagagagctcagtgagtataaaagagtgatacctacattgttttaaattgcatccagcccaagttaacatattaaaaactgtgtttgcctcctcagtttccaaaccacaaagatacttagtcttgcccattgggctgaatagatgaaataattacacactaatatgagttgtaaaacttaccaaagataattcagataatgggtatgcttatgatttgataagaacttttaccttccgagtaatttcactctttcattgcaatatatgtactgaactatatatccaacatattataaagttcgtcatgatatggcagaaaaaaaggcatgacaagaagagagagaataattttgcctgtggtcattagttttgaagtagtagaaaatgtctaaatattaggtggagcaaactagtaaaattggctcaagttttgattccacaacttcctttctctaacactctgcagctttggagcaattcccatcgaccagagttggtccgaccagccttggaaaggtcactgaaaaatcttcaattggactatgctgacctctatcttattcattttccagtgtctgtaaaggtaggcagcttgtgtgatcaaattaatttcacttttgttctcagcataaatattgttttcatggagatttgaactaagctttttcttaggaggacatagggattttaacatggaagaagagccctaaacataactcctaattcctttctatggaacagaaagcaattttgaatccatacttccgtgattcgatgtctacaagaaaagagagtcgagaatcctcaaaagcctctgcctaaaaaacttgaggaaatgacaatcgatctccttgaaggctactaaggtcttatgaatgattcctgatgcacctcttgggatgttcacagacacagagtttcatgaagctgtggagtccagaaaacctgctgcacatagggtgcacaatgagtttccatttcttgcctcttttcaaggggcaagaactcagtccgggaatgtcttaaactacaaaccttcatgggaaaccttgttgcttctgcttcctctcttttcacactggaggtttgattttttcttagccatgtaattcccddgatatatgtactaactatatatcgaacatatgataaagttgatcatgatatggcagaacaaaaggcatcacaagaagagagagaataatttggcctgtggtcattagttcggaagtagtaaatgtctaaatattaggtggagcaaactagtaccddaaactggctgaagttgggattggccactggttgctctaacctctgcagctttggagcaattcccatcgaccagagttggtccgaccagccttggaaaggtcactgaaaaatcttcaattggactatgctgacctctatcttattcattttccagtgtctgtaaaggtaggcagcttgtgtgatcaaattaatttcacttttgttctcagcataaatattgttttcatggagatttgaactaagctttttcttaggaggacatagggattttaacatggaagaagagccctaaacataactcctaattcctttctatggaacagaaagcaattttgaatccatacttccgtgattgcatgtctacaagaaaagagagtgcagaatcctcaaagcctctgcctcaaaaacttgaggaaatgacaatcatctccttgaaggcacaaggtcttatttatgattcctgatttcacctcttgggatgttcacagacacagagtttcatgaagctgtggtgtcagaaaacctgctgcacatagggtgcacaatgagtttccatcttcttgcctcttttcaagggggcaagaactcagtccgggaatgtcttaaactacaaaccttcatgggaaaccttgttgcttctgcttcctctcttttcacactggacggtttcatttttgcttagccatgaattcttgtgtcattcataacttttgtcttaaggaactgaaaactagtcaggctagttaatgcaaaagggtatattagatatgactaatgggaaatcaaagccagggtacattaagaatttgataaaaactctaaaaatatatcctttctccacccttatctctgctttattacaaaaggctttttaaatatttgttccaacctttttcgttggtggcatttatggctttggagttcactgtcaggcccatgttcattaccgtgagctcctgtgcatctcctaatttccaaactagcctggaaaacgcctccattgaccatgattggttcatggtcctgtgcacggaacatcacatgttcagggagataaagaactctgatagtggcacctgggtaaaaagtacaatccattatatctggatatcaagatcttttgcagttgaagagaggtattgccacagagaaaattataggagcagaagaaagtcaatgaaagtcaatgatgacactccattaggaaccagaaagatggtatttatttacacatataataggtgtaagagattagaggaagcctgtcacctgaagacattccttataccttcatatgtagtacactttgtacataccactctctggagcgctgcatcacctacctcatggaggattagtgtccttaaatgtacctcagagcatggctatgtgtggagaaattgacttgtgacatcactaaactgactgcttctacttcagccaggtgaggaagtgatcccaaaagatgaaaatggaaaaatactatttgacacagtggatctctgtgccacatgggaggtgagtgtttggaggtgagagaacggataagaaagatgaggtaggatacatctgtttcctatcttcttagtacaagtatggaaaatgcaccattggatcaaaaacttaggaactttacaaaggtagtttttgtgagcagcgaggaaaaagaaatgacaggcatacaaaagagagaagtggtggagaagaattgggggtaaggaggactgggatttctttccttgcctgtacattaatctctccactttcctaaggaggaaacagaaattctcactcttgcaatcactatcttcttccccaatttttctgttttattttctcccttttaagaaccacggctagctagtttgattgtcacatctagacagttgttgctttcacagttctatgttacatttatcttgctcttcagtcgactacacaaatgatacctcacaattcctttttccaggccatggagaagtgtaaagatgcaggattggccaagtccatcggggtgtccaacttcaaccacaggctgctggagatgatcctcaacgagccagggctcaagtacgagcctgtctgcaaccaggtgaggcgccctcagcctcctctgcctttctgttcttcatgcccctgctttctgtcctattggccaagtatccattcatttagacccacttatctttgtaaaagagaagattctagagaacaaagcctcttcctagaagggcatggagtcctcttacttgtaccctgcttagaaaagtcttacgaaaaggtgttgtaactttgatgctgaattgtgtgttacatttataggaggtcaattcgatcaagaagtccaaggattgccaattagactcagggaaaggtggattacccctaagctatgaaagatgaccagagagtggacgggctgaaggtgatttggagggaactgtgcatagatatgaagccatgaagagatgaaatgaacagtacataaggagagagtgagagcaagagaagagaaatactagggattcacatgggcttcggatgtctcagtgcctcttggtgtctctgctttcacacttcttgaccaagggcatagatacactaaaaattatctgcagacagtgaaggtcatccatggtagaaagagaaaatgacctgtttatggagatatctgttcacagtggatgaaatccacactgaggaaggttcagcagaacatggagctgacctatgactgcgggctcctagtcggctgctttttggagtctgtcatgcaatcagctgcttaaacacatctattctatgcatggttctctcatagcctagagataattccatcttttccttgagtcctgactggtgattccaggcctccttgatcaaattgactgcccccaaatgttacacacatttcagcattaaaatcactacacctttcccagtaacttacattttttgttataattttgttataatttggtataatgatatggtctgtgataatttaataaaagcattgagaaattaatgtggtttaatactagtagttccccaatttttaatatggccattttcacactttccaaaaatttgataaaaataatactggagacccatgttaccatttatattcaaaattactaacattttgcaatgttatatggagtatatctgcataaatacatataatgtttctagaacctcttcaaggtaaattgtaaagatgacaattgacccctagagacctctcaaagcatgtcacaggaatgaagatattctcccagttccagtgtcattactgtatctaagaacatcatttatagtgcccttatgtcatttggtatccggtccatattttaatttttcattgcttaatcaaaatatcttttgtagctcttctttttttaaccagaattcaattgtttttatattgttgtatttgatatatcagttaacttgtttttcccagttgaaggttcctgtaaattaaaagttagatgtgagtattttattacattggcttaaaactttggggcaagaaaatgtttttatcatgctgtgtttttcaaattgcacgacactagactgcatacaatcacagaatgccccactagtggtgaaggtagttttaaaaacttggttaagctaacagtggtcagatctgttgtttttaactcatgttttctctttaacaattactagtaatctgctgggggataattctcaacagaagaagtcatattcccatgacaaattttcacatatgattgagtatacatcagtgatttgaacttttttctactgcatttctgttttcttctttgttatttcttatttgttatttccttggggtttttacataatcatttacaattttaaccacttgtttaactattcttacctgacatttaattaaaaataatttctcaccaagtaaaaataataaactactattcctctaagtgagagtaaaggtaaaccttcttgccttcaattagcaatgtactgtgaacgaattactgtaatgaccaccatcagagtagacaaagattgttgttctttttctcattgtcgcactaattgctacagactcacggattcttgtgtatgatttttaatttattttactcattttttaatgctcacatctactcagcatatatatatatattatatatatataatatatatgaagaagatgtggatcaaagactcatgagggcaagtgtaaaagacaaaagcacttgtttcatagggaacccactggtgacatttgagatatcaacatacaaaatccatcatacaaaaaggaaaagtaatgaaagactgtgaaaattatcagtatttatgtgtatatgtatattttctagttcatctatatagatatatatcatagatggcatatatgatatatatatgtcagatcaattagaaaacatacatatatatgtatgcatttttggtattaattaggaaactagttcttttgtttttcagacctgccctcatgagtctttgaccaaattcttgatttctggcacgatttgatgcccaaggctcaaagaatcttacctcatcccagctctgaaattggccgtgtctccttctagtggtcggagttattgagaaaccagataggttcatgagttgcttgtgctcagaaatagcatttctattttcttaggagagagggggcataaaatttatttttatgaaaaagatcatttttgaccaataatattctcagttcaaatttaatgctctacattattcagcttcttttactttggtgattttaatattaatgtaacttttggattatctgatgcttttccatcttgctcgtctgcaggtggaatgtcatccttacttcaaccagagaaaactgctggatttctgcaagtcaaaagacattgttctggttgcctatagtgctctgggatcccatcgagaagaaccatggtaataagagatacaggaagtttgccgaaaacactggtatgataaaaaagctgggagaaaaagggatcatgctgtttcctggagttcactcacagctgacttggggtgagggaagaatttgcatttctgacgagatcccaggtgatgttgaggctgctgtttgggggcctcgcttgagaagctccggtgcagagtggacgccttagtctgttagggagccgcctaacaaactgtatccccagcctcagggcctcagcctttctgcctttccttccagggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgaggagcggggctgtgggcctcaggtctcctgcacagtgtccttcacacgtgtgcttcttgtaaggctctcaggacagccttgggccagctccatttccctgtatttcctatgcatgaactctttgtgtacgtcataagggtttcttctactctagcacaggagaggcaacagaggtggagagtaataggatgggatcagaactacagatttgggttagcgttaagtcagtgatatccatatccctctgctggggccatgtccttttctttattttttataatgaagcattgattagatgttctttagtctccaactcatggcggatttttcttcttgtatgtttatgtagtataaattccttatatttattctcttagaattttatctttgcgaagtgcttgtttaactctgcctttttttttggcgaggtggttgtgtgtctttatttttatgtgtaggagaccatatttataccaataccttaggatataagacaaacccacttaatatagaggcttaatgcacaagcatttattgagctcaaggttccatggttagaaaattagcctgggctcagcctaaactcagtccattccttctattcctggctgggctctcatgtgtgttctgggcagtgaaggagctctgcttcaggatgtccctggggcatttgtgtgagtgcccccctctcccatgcagttctttatcctccagccatccagcccagggttcacctcagcacagggcatagtgaatggacatgtgcaaagcctttttaggtctaggctcagagacaccaaccattgcttctgggaaattctatcacctaatgcaagttacaggacaggtagactaaggggtggggaaacacacaccacctcttactggaaggaactgaaattcgatatagccaagcaagtggacacagggacatatgactgttagagggcatgttcctaattgaatcgtatcgattcatatgatatgtgtgaaataatatatcaatagttatatgtatgaatatgaatatatataaattgatatattatttcatatattctcaagaattcatacaagtctctaaagaattaacatccagaatacatacatatgtgtatgttttctaattaggtagatacataaaatatacatcatgtatgatatatattataaaacctatgtcatatatatgacatatatcatgtatatgtatatacgtcactatttgctaaaacattaagtaaaataagtgaagaaatcgataggatactctgaaatagtgatacagagaacgagagaataaaaaatgacaataatgaaacaattgatgaatcgaggtaatggcattccttaaattatttttaaaatatttttggacattagagaattccaaaaaaaaaatgaaaagttatgaaagaatgtggaaattataagtattaatacatatgtgtatgtctctaatcgatctagtatatataagatatatatgatatatgacatatgtgtatataatatatatgtagatactagaaccatacatatatatgtattatctgatataatcttagagacttgaatgtatcttgaaataacatctcccaaatttatctgcgttgtcatattctctgtggttatgtttttcacaaacaaaagtttctatccttcatgtagactaatttttcatgcctctttcttgtggttggtgtgtgttgtgtcttatcctatattgggaatatcacaatattttactgtgttatcttacaaaattgttaatattctttccttataaatttggttaattctaatgggtatgacttttaaaatattatgtgaaataaggatccaaatatgcgtatctaatttttgaatttttagcaaaatttaccatttattgaaaagtttatatttgctcacataacttgaatttttttacctgacacatatatgaaatgtccatgagcaattatctggcctctcttccatcttcagttaacttattcacttttctgtgctataatgttaaaaagtaagtttcacttcatatggacaatattttctacttcttcatttatttaataatatcttagttattcttgactaatgtgttatttaaaattttgaatcatcttattaacttccacaggcaagtaaatgttttagtctctcattgatcattgtaataagcctgcagatcaatgcagagagaactgaatctttgataatattgagatttccagtccatcgatcataatatgaatatcccactacttattaataaatcatctcttaataaatatatcattaattgcataaatttctccacgactgatcattttttttttgagacagagtctcgttctgtcacccagggtggagtgcagtggcacgaactcggctcactgcaacctccacctcccgggttcaagcagttctcctgcctcagcctccagagtagctgggactgctggcgcatgctgccatgcccagctaattttttgtattttagtagagacggggtttcactgtgttgcccaggctgttgcccaggctgttctctaactccgtaaatcaggcaatcctcctgcgctggcctcccaaagtgctaggattataggcgtgagccaacgtgcccggcaattactgataattttaatagtttttgacaacttttcattttcattttgtggattttctaatatatagaaatattaaaagaataatgcaacaaatcttctacctacattcatcaagtgttacattgctgtcatttttttactctctatctctcattttctgtattactccttcagtttccctatggatttatacacttatttgattgaatgtattagtttgagtgacatctttttgatatttagagtctcccaaatttacatagtgagtacccacaccttttgaatgtgaaatcgttagtatttagacaattattggcttgagtgatgttgaaaactgatttttcctattatacctgttcattggagagatagatattcaatgttattcatcaaacctactaaattatgctagacattacaaaattgcctctagattcttgtggggtcttctaggtacatggccctatcatgtgggcacaaagtaagctctgtttcttcttcagcttcctctgagatattctcttcatctgcagtgttgtgcagtttcaaaatattttatctgggaatggatttctgcttatttttgactggttttcattgaccacttgggtgtttagagaggtctttcataaattttggaaacgtatcaatcttttttaagtattgtctctgcaccctattgtctgatgaacttggttgttcccaattggcaatgatgtaatctaaaaataattaaagttccctattactgtgataggtgtttgaattccagttgacttcagaggagatgaaagccatagatggcctaaacagaaatgtgcgatatttgacccttgatatgtaagtgattttggagatggttgttctaatttatttcagaggaggaacgtaggatgggtgttgagagtgtgacctccacaccaggggcacagaggccaacgtagaacagaggtgagaacaggagctttctggaagtctcctcctggattcactccagagctctgttctctggcagggagagtggcctggggtcagcatgggtcaacctgtgcctctgctctcgtgactccaaggaactttccagagcagccaagatcattgctgaatccgcaccttccatgcaggcctgccgtttgtattactgtctagtgtacacactgtggatatggccatgtggtcgcattagatgtttccaaatctgcgcttctatcttgttcttcccaacctgctcaatgtcttaccagatgggaggcagttccgtcaatcttgtgggccaggttccaattccacctctttcacatggatgcttgctggatcctgtcaatttagcattttgaatcatttcaaaccttttacgagcctttctttgcatgttttcccatgagccaaatactgcatttgcctccagaaagtctgtcttagtggagcgaataggagcacttggccttggtgttctgcaatatggagatctcagtgtagagaatgagaagtgttaaaatcaaatgcagagtgtagatgcaaaagcaccattattggagataatttataaccagtaacgagacgttttactattcctctatattctaaggtttctaggattcatacgaaggatcattcatataatgagggaaaaaggaggtaaggtactgactgcagtaagaatttcaccaggtatataggggatgatggggattatgtgtgaaaaaaaacaagcacatggtacatcatagtacccaaaatttggtggatattattagtagtattttatccgcttagcagaaaatacaaaatgaaaaatggaaatgataataagaaaaggaaaagtggcaagcattagaaatgtttacttctgattaatgttttttatgatcatgaaatcaatcactagtgttattgggtagaactcaaatatggtctggagtaaaccacttgcgagctccaagtgtttgctctcggtgtaatcacaaaggataggctcaattccggtaattaacaagttataactgtatatgtgagcagtcatttatctgtgtctttacattttggattatgtctacctataaaatggtttatgcattgtagctctctaatattgggccctatacataaacaataatttaacgtgtctaatctaaccaagtgtgttgcgtatgataggcaggtagtaagtaatatgtaaagtaataaaataaagaacaattactaccagtataattaatgtactcaaaattgtttattagtgatgagcatatatcttccttattcctcttcaatgtaaggcagaaggagttcctgttggaagtgagaatgtgaaatagaaaaggtcagaatgtctctccattgacagatgtgggatctgttgttgagagatgtagagaaatatggtttgacatttcaccttgtgtgttttatgtggttaagttccaggcaggggaatagaattaaattattctttattttgaaaatcaagatatgataaagtcacgagttcattaaacaaagaaacacagattctagagcagtcagaaaatgaacttcttaacatctacactagcggcagcttcctagaaatcactgcgctaccggctagtaacggagtcattgccattcagagtgtgcatttttttttcctctttccagttttgctggcccccctaattatccgatttctgatgaatattaacatggagggcattgcatgaggtctgccagaaggccctgcgtgtggatggtgacacagaggatggctctatgctggtgactggacacatggcc

SEQ ID NO: 1805 - DNA, 791 bp, Homo sapiens
ctctggctggacgccgccgccgccgctgccaccgcctctgatccaagccacctcccgccagagaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcaggactatgtgcagatgaaggccagtgagctggagcaggagcaagagagagagggctccagcctggacagccccagatctaagcggtgcggtaatctgagtacttgcatgctgggcacatacacgcaggacttcaacaagtttcacacgttcccccaaactgcaattggggttggagcacctggaaagaaaagggatatgtccagcgacttggagagagaccatcgccctcatgttagcatgccccagaatgccaactaaactcctccctttccttcctaatttcccttcttgcatccttcctataacttgatgcatgtggtttggttcctctctggtggctctttgggctggtattggtggctttccttgtggcagaggatgtctcaaacttcagatgggaggaaagagagcaggactcacaggttggaagagaatcacctgggaaaataccagaaaatgagggccgctttgagtcccccagagatgtcatcagagctcctctgtcctgcttctgaatgtgctgatcatttgaggaataaaattatttttcccc

SEQ ID NO: 1806 - protein, 255 aa, Homo sapiens
MVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLELEVSHEETEHSYHVEETVSQDCNQDMEEMMSEQENPDSSEPVVEDERLHHDTDDVTYQVYEEQAVYEPLENEGIEITEVTVPPEDNPVEDSQVIVEEVSIFPVEEQQEVPPDT

SEQ ID NO: 1807 - protein, 226 aa, Homo sapiens
MPLSQIKKVLDIRETEDCHNAFALLVRPPTEQANVLLSFQMTSDELPKENWLKMLCRHVANTICKADAENLIYTADPESFEVNTKDMDSTLSRASRAIKKTSKKVTRAFSFSKTPKRALRRALMTSHGSVEGRSPSSNDKHVMSRLSSTSSLAITHSVSTSNVIGFTKHVYVQRLNSTGGRSQYSWFQSVRHSAFRASFSEILEGNTDFSNFKKVLSKSSLTFVKN

SEQ ID NO: 1808 - protein, 52 aa, Homo sapiens [sequence omitted]

SEQ ID NO: 1809 - protein, 592 aa, Homo sapiens
MASEIHMTGPMCLIENTNGRLMANPEALKILSAITQPMVVVAIVGLYRTGKSYLMNKLAGKKKGFSLGSTVQSHTKGIWMWCVPHPKKPGHILVLLDTEGLGDVEKGDNQNDSWIFALAVLLSSTFVYNSIGTINQQAMDQLYYVTELTHRIRSKSSPDENENEVEDSADFVSFFPDFVWTLRDFSLDLEADGQPLTPDEYLTYSLKLKKGTSQKDETFNLPRLCIRKFFPKKKCFVFDRPVHRRKLAQLEKLQDEELDPEFVQQVADFCSYIFSNSKTKTLSGGIQVNGPRLESLVLTYVNAISSGDLPCMENAVLALAQIENSAAVQKAIAHYEQQMGQKVQLPTESLQELLDLHRDSEREAIEVFIRSSFKDVDHLFQKELAAQLEKKRDDFCKQNQEASSDRCSGLLQVIFSPLEEEVKAGIYSKPGGYRLFVQKLQDLKKKYYEEPRKGIQAEEILQTYLKSKESMTDAILQTDQTLTEKEKEIEVERVKAESAQASAKMLQEMQRKNEQMMEQKERSYQEHLKQLTEKMENDRVQLLKEQERTLALKLQEQEQLLKEGFQKESRIMKNEIQDLQTKMRRRKACTIS

SEQ ID NO: 1810 - protein, 57 aa, Homo sapiens [sequence omitted]

SEQ ID NO: 1811 - protein, 148 aa, Homo sapiens
MRGSELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDVGSKGKVGRLSAPGSQREGRNPQLNQQ

SEQ ID NO: 1812 - protein, 474 aa, Homo sapiens
MVQQTNNAENTEALLAGESSDSGAGLELGIASSPTPGSTASTGGKADDPSWCKTPSGHIKRPMNAFMVWSQIERRKIMEQSPDMHNAEISKRLGKRWKLLKDSDKIPFIREAERLRLKHMADYPDYKYRPRKKVKSGNANSSSSAAASSKPGEKGDKVGGSGGGGHGGGGGGGSSNAGGGGGGASGGGANSKPAQKKSCGSKVAGGAGGGVSKPHAKLILAGGGGGGKAAAAAAASFAAEQAGAAALLPLGAAADHHSLYKARTPSASASASSAASASAALAAPGKHLAEKKVKRVYLFGGLGTSSSPVGGVGAGADPSDPLGLYEEEGAGCSPDAPSLSGRSSAASSPAAGRSPADHRGYASLRAASPAPSSAPSHASSSASSHSSSSSSSGSSSSDDEFEDDLLDLNPSSNFESMSLGSFSSSSALDRDLDFNFEPGSGSHFEFPDYCTPEVSEMISGDWLESSISNLVFTY

SEQ ID NO: 1813 - protein, 238 aa, Homo sapiens
MESSAKMESGGAGQQPQPQPQQPFLPPAACFFATAAAAAAAAAAAAAQSAQQQQQQQQQQQQQQAPQLRPAADGQPSGGGHKSAPKQVKRQRSSSPELMRCKRRLNFSGFGYSLPQQQPAAVARRNERERNRVKLVNLGFATLREHVPNGAANKKMSKVETLRSAVEYIRALQQLLDEHDAVSAAFQAGVLSPTISPNYSNDLNSMAGSPVSSYSSDEGSYDPLSPEEQELLDFTNWF

SEQ ID NO: 1814 - protein, 68 aa, Homo sapiens
MVYYPELFVWVSQEPFPNKDMEGRLPKGRLPVPKEVNRKKNDETNAASLTPLGSSELRSPRISYLHFF

SEQ ID NO: 1815 - protein, 572 aa, Homo sapiens
MSYQGKKSIPHITSDRLLIKGGRIINDDQSLYADVYLEDGLIKQIGENLIVPGGVKTIEANGRMVIPGGIDVNTYLQKPSQGMTAADDFFQGTRAALVGGTTMIIDHVVPEPGSSLLTSFEKWHEAADTKSCCDYSLHVDITSWYDGVREELEVLVQDKGVNSFQVYMAYKDVYQMSDSQLYEAFTFLKGLGAVILVHAENGDLIAQEQKRILEMGITGPEGHALSRPEELEAEAVFRAITIAGRINCPVYITKVMSKSAADIIALARKKGPLVFGEPIAASLGTDGTHYWSKNWAKAAAFVTSPPLSPDPTTPDYLTSLLACGDLQVTGSGHCPYSTAQKAVGKDNFTLIPEGVNGIEERMTVVWDKAVATGKMDENQFVAVTSTNAAKIFNLYPRKGRIAVGSDADVVIWDPDKLKTITAKSHKSAVEYNIFEGMECHGSPLVVISQGKIVFEDGNINVNKGMGRFIPRKAFPEHLYQRVKIRNKVFGLQGVSRGMYDGPVYEVPATPKYATPAPSAKSSPSKHQPPPIRNLHQSNFSLSGAQIDDNNPRRTGHRIVAPPGGRSNITSLG

SEQ ID NO: 1816 - protein, 325 aa, Homo sapiens
MTERRRDELSEEINNLREKVMKQSEENNNLQSQVQKLTEENTTLREQVEPTPEDEDDDIELRGAAAAAAPPPPIEEECPEDLPEKFDGNPDMLAPFMAQCQIFMEKSTRDFSVDRVRVCFVTSMMTGRAARWASAKLERSHYLMHNYPAFMMEMKHVFEDPQRREVAKRKIRRLRQGMGSVIDYSNAFQMIAQDLDWNEPALIDQYHEGLSDHIQEELSHLEVAKSLSALIGQCIHIERRLARAAAARKPRSPPRALVLPHIASHHQVDPTEPVGGARMRLTQEEKERRRKLNLCLYCGTGGHYADNCPAKASKSSPAGNSPAPL

SEQ ID NO: 1817 - protein, 357 aa, Homo sapiens
MLQIHLPGRHTLFVRAMIDSGASGNFIDHEYVAQNGIPLRIKDWPILVEAIDGRPIASGPVVHETHDLIVDLGDHREVLSFDVTQSPFFPVVLGVRWLSTHDPNITWSTRSIVFDSEYCRYHCRMYSPIPPSLPPPAPQPPLYYPVDGYRVYQPVRYYYVQNVYTPVDEHVYPDHRLVDPHIEMIPGAHSIPSGHVYSLSEPEMAALRDFVARNVKDGLITPTIAPNGAQVLQVKRGWKLQVSYDCRAPNNFTIQNQYPRLSIPNLEDQAHLATYTEFVPQIPGYQTYPTYAAYPTYPVGFAWYPVGRDGQGRSLYVPVMITWNPHWYRQPPVPQYPPPQPPPPPPPPPPPPSYSTL

SEQ ID NO: 1818 - protein, 102 aa, Homo sapiens [sequence omitted]

SEQ ID NO: 1819 - protein, 831 aa, Homo sapiens
MERAGATSRGGQAPGFLLRLHTEGRAEAARVQEQDLRQWGLTGIHLRSYQLEGVNWLAQRFHCQNGCILGDEMGLGKTCQTIALFIYLAGRLNDEGPFLILCPLSVLSNWKEEMQRFAPGLSCVTYAGDKEERACLQQDLKQESRFHVLLTTYEICLKDASFLKSFPWSVLVVDEAHRLKNQSSLLHKTLSEFSVVFSLLLTGTPIQNSLQELYSLLSFVEPDLFSKEEVGDFIQRYQDIEKESESASELHKLLQPFLLRRVKAEVATELPKKTEVVIYHGMSALQKKYYKAILMKDLDAFENETAKKVKLQNILSQLRKCVDHPYLFDGVEPEPFEVGDHLTEASGKLHLLDKLLAFLYSGGHRVLLFSQMTQMLDILQDYMDYRGYSYERVDGSVRGEERHLAIKNFGQQPIFVFLLSTRAGGVGMNLTAADTVIFVDSDFNPQNDLQAAARAHRIGQNKSVKVIRLIGRDTVEEIVYRKAASKLQLTNMIIEGGHFTLGAQKPAADADLQLSEILKFGLDKLLASEGSTMDEIDLESILGETKDGQWVSDALPAAEGGSRDQEEGKNHMYLFEGKDYSKEPSKEDRKSFEQLVNLQKTLLEKASQEGRSLRNKGSVLIPGLVEGSTKRKRVLSPEELEDRQKKRQEAAAKRRRLIEEKKRQKEEAEHKKKVAWWESNNYQSFCLPSEESEPEDLENGEESSAELDYQDPDATSLKYVSGDVTHPQAGAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAA

SEQ ID NO: 1820 - protein, 212 aa, Homo sapiens
MLNKVLSRLGVAGQWRFVDVLGLEEESLGSVPAPACALLLLFPLTAQHENFRKKQIEELKGQEVSPKVYFMKQTIGNSCGTIGLIHAVANNQDKLGFEDGSVLKQFLSETEKMSPEDRAKCFEKNEAIQAAHDAVAQEGQCRVDDKVNFHFILFNNVDGHLYELDGRMPFPVNHGASSEDTLLKDAAKVCREFTEREQGEVRFSAVALCKAA

SEQ ID NO: 1821 - protein, 323 aa, Homo sapiens [sequence omitted]

SEQ ID NO: 1822 - protein, 141 aa, Homo sapiens
MGFQKFSPFLALSILVLLQAGSLHAAPFRSALESSPADPATLSEDEARLLLAALVQDYVQMKASELEQEQEREGSSLDSPRSKRCGNLSTCMLGTYTQDFNKFHTFPQTAIGVGAPGKKRDMSSDLERDHRPHVSMPQNAN

SEQ ID NO: 1823 - DNA, 6188 bp, Homo sapiens
caacaacaacaactccaagcacaccggccataagagtgcgtgtgtccccaacatgaccgaacgaagaagggacgagctctctgaagagatcaacaacttaagagagaaggtcatgaagcagtcggaggagaacaacaacctgcagagccaggtgcagaagctcacagaggagaacaccacccttcgagagcaagtggaacccacccctgaggatgaggatgatgacatcgagctccgcggtgctgcagcagctgctgccccaccccctccaatagaggaagagtgcccagaagacctcccagagaagttcgatggcaacccagacatgctggctcctttcatggcccagtgccagatcttcatggaaaagagcaccagggatttctcagttgatcgtgtccgtgtctgcttcgtgacaagcatgatgaccggccgtgctgcccgttgggcctcagcaaagctggagcgctcccactacctgatgcacaactacccagctttcatgatggaaatgaagcatgtctttgaagaccctcagaggcgagaggttgccaaacgcaagatcagacgcctgcgccaaggcatggggtctgtcatcgactactccaatgctttccagatgattgcccaggacctggattggaacgagcctgcgctgattgaccagtaccacgagggcctcagcgaccacattcaggaggagctctcccacctcgaggtcgccaagtcgctgtctgctctgattgggcagtgcattcacattgagagaaggctggccagggctgctgcagctcgcaagccacgctcgccaccccgggcgctggtgttgcctcacattgcaagccaccaccaggtagatccaaccgagccggtgggaggtgcccgcatgcgcctgacgcaggaagaaaaagaaagacgcagaaagctgaacctgtgcctctactgtggaacaggaggtcactacgctgacaattgtcctgccaaggcctcaaagtcttcgccggcgggaaactccccggccccgctgtagagggaccttcagcgaccgggccagaaataataaggtccccacaagatgatgcctcatctccacacttgcaagtgatgctccagattcatcttccgggcagacacaccctgttcgtccgagccatgatcgattctggtgcttctggcaacttcattgatcacgaatatgttgctcaaaatggaattcctctaagaatcaaggactggccaatacttgtggaagcaattgatgggcgccccatagcatcgggcccagttgtccacgaaactcacgacctgatagttgacctgggagatcaccgagaggtgctgtcatttgatgtgactcagtctccattcttccctgtcgtcctaggggttcgctggctgagcacacatgatcccaatatcacatggagcactcgatctatcgtctttgattctgaatactgccgctaccactgccggatgtattctccaataccaccatcgctcccaccaccagcaccacaaccgccactctattatccagtagatggatacagagtttaccaaccagtgaggtattactatgtccagaatgtgtacactccagtagatgagcacgtctacccagatcaccgcctggttgaccctcacatagaaatgatacctggagcacacagtattcccagtggacatgtgtattcactgtccgaacctgaaatggcagctcttcgagattttgtggcaagaaatgtaaaagatgggctaattactccaacgattgcacctaatggagcccaagttctccaggtgaagagggggtggaaactgcaagtttcttatgattgccgagctccaaacaattttactatccagaatcagtatcctcgcctatctattccaaatttagaagaccaagcacacctggcaacgtacactgaattcgtacctcaaatacctggataccaaacataccccacatatgccgcgtacccgacctacccagtaggattcgcctggtacccagtgggacgagacggacaaggaagatcactatatgtacctgtgatgatcacttggaatccacactggtaccgccagcctccggtaccacagtacccgccgccacagccgccgcctccaccaccaccaccgccgccgcctccatcttacagtaccctgtaaatacctgtcatgtccttcaggatctctgccctcaaaatttattcctgttcagcttctcaatcagtgactgtgtgctaaattttaggctactgtatcttcaggccacctgaggcacatcctctctgaaacggctatggaaggttagggccactctggactggcacacatcctaaagcaccaaaagaccttcaacattttctgagagcaacagagtatttgccaataaatgatctctcatttttccaccttgactgccaatctaactaaaataattaataagtttactttccagccagtcctggaagtctgggttttacctgccaaaacctccatcaccatctaaattataggctgccaaatttgctgtttaacatttacagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatccgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaacttttttttttccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgc

SEQ ID NO: 1824 - DNA, 866 bp, Homo sapiens
ggcagagccacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaagggtttttcagggacccctggctccaatgagaattctacccagaatgtgtataagattcctcctaccaccactaaggccttgtgcccactctataccagccccagaactgtgacccaagctccacccaagtcaactgccgatgtctccactcctgactctgaaatcaaccttacaaatgtgacagatatcatcagggttccggtgttcaacattgtcattctcctggctggtggattcctgagtaagagcctggtcttctctgtcctgtttgctgtcacgctgaggtcatttgtaccctaggcccacgaacccacgagaatgtcctctgacttccagccacatccatctggcagttgtgccaagggaggagggaggaggtaaaaggcagggagttaataacatgaattaaatctgtaatcaccrgctaaaaaaaaaaaaaaaaa

SEQ ID NO: 1825 - protein, 234 aa, Homo sapiens
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFSGTPGSNENSTQNVYKIPPTTTKALCPLYTSPRTVTQAPPKSTADVSTPDSEINLTNVTDIIRVPVFNIVILLAGGFLSKSLVFSVLFAVTLRSFVP

What is claimed is:

1. A method for determining the presence of a lung cancer in a patient, comprising the steps of:

(a) obtaining a biological sample from the patient;

(b) contacting the biological sample with an oligonucleotide or polynucleotide that hybridizes to a sequence set forth in SEQ ID NO:808, or a complement thereof complete, under moderately stringent conditions;

(c) detecting in the sample an amount of an expressed polynucleotide that hybridizes to the oligonucleotide; and (d) comparing the amount of polynucleotide that hybridizes to the oligonucleotide to a predetermined cut-off value, and therefrom determining the presence or absence of the cancer in the patient.

2. A method for monitoring the progression of a lung cancer in a patient, comprising the steps of:

(a) contacting a biological sample obtained from the patient with an oligonucleotide or polynucleotide that hybridizes to a sequence set forth in SEQ ID NO:808, or a complement thereof complete, under moderately stringent conditions;

(b) detecting in the sample an amount of an expressed polynucleotide that hybridizes to the oligonucleotide;

(c) repeating steps (a) and (b) using a biological sample obtained from the patient at a subsequent point in time; and (d) comparing the amount of expressed polynucleotide detected in step (c) to the amount detected in step (b), and therefrom monitoring the progression of the cancer in the patient.

3. The method of claim 1, wherein the biological sample is selected from the group consisting of: sputum, blood, and bronchial lavage samples.

4. The method of claim 2, wherein the biological sample is selected from the group consisting of: sputum, blood, and bronchial lavage samples.

5. A method for determining the presence of a lung cancer or a head and neck cancer in a patient, comprising the steps of:

(a) contacting a biological sample obtained from a patient with at least two oligonticleotides under conditions wherein said oligonucleotides are effective for amplifying a polynucleotide sequence of SEQ ID NO: 808 in a reverse transcription polymerase chain reaction;

(b) detecting in the sample an amount of polynucleotide amplified in step (a); and (c) comparing the amount of the polynucleotide amplified in step (a) to a predetermined cut-off value, and therefrom determining the presence of a cancer in the patient.

* * * * *

UNITED STATES PATENT AND TRADEMARK OFFICE
CERTIFICATE OF CORRECTION

PATENT NO.     : 6,667,154 B1                                          Page 1 of 1
DATED          : December 23, 2003
INVENTOR(S)    : Tongtong Wang and Liqun Fan It is certified that error appears in the above-identified patent and that said Letters Patent is hereby corrected as shown below:

Title page,
Item [75], Inventors, "Tongtong Wang, Chaitanya S. Bangur,Michael J. Lodes, Gary R. Fanger, Thomas S.Vedvick, Darrick Carter , Marc W. Retter, Jane Mannion and Liqun Fan" should read as -- Tongtong Wang and Liqun Fan --
Item [56], References Cited,U.S. PATENT DOCUMENTS, the following should also be listed : -- 5,648,226     7/1997     Van Den Eynde et al.     435     7.24 --
FOREIGN PATENT DOCUMENTS, the following should be listed:
-- EP 1033401  A2   09/06/00     EPO
   WO 00/22130      04/20/00     WIPO
   WO 00/21990      04/20/00     WIPO
   WO 99/20750      04/29/99     WIPO --
OTHER PUBLICATIONS,the following should also be listed:
-- Geneseq Accession Number AAC10552, October 6, 2000.
   Geneseq Accession Number AAC17098, October 6, 2000.
   Geneseq Accession Number AAA42613, August 21, 2000.
   Geneseq Accession Number AAX55997, July 15, 1999.
   Geneseq Accession Number AAA45936, August 23, 2000. --.

Signed and Sealed this

Twenty-fifth Day of May, 2004

JON W. DUDAS
*Acting Director of the United States Patent and Trademark Office*